United States Patent 10,724,096 (METHODS AND COMPOSITIONS FOR INHIBITING AND TREATING NEUROLOGICAL CONDITIONS) - sequence listing, part 63

SEQ ID NO: 1423 - DNA, 99552 bp, Homo sapiens
agagtgaaaaattgcctgcccaagcaaatagttcctaaaatgttctcactaccaggtcttaaccatgaaacctactgggccagaaggttgggatatccagttttcacttaggaacaagcgatgtcacataatacatagccatagcttccagctgactcctcatttgcagactgcctaggtctccagctacctggagatcagcattctgaaccctttctccacggtggcatcataaaattcacatgcttgatatgctctctgcaattcttggtgaaatatctacaatccattcccctctgtccaaacaaaaaaaaagttggaatacaggtgagtgagagtgagttatgtcgtatttgctttcatttatttttaaaagggatgtacttcccaaaagtgtttctatgaactgtggttggtcatcaataacttcaatacaacacccgatatgtgtcctgtcagcaactgcattttactgttcttggccaatgtggccccttctgcatactcttctatgcccatcttcccccagcgtgccatagtatgtcctccttgcaaggccttaatcacattccaggccattaactcctaaaaatgtgatgcagtctgatagaagtgcagacaccaaattcttccacagatgccctgctcttgggtttgactgggctggagatttggcagcatgtttgccatggttaatttggaggcaaatctcaaggaaacagaacattaaaaagtttggatatggcttggcatcctcagcacacctaatccaaatgggaaaacgtttacccccattctcttgaggaaggggggctatggaaaatgtgcaggttgagaatagggagacccaggtttaaatcatggttccccttggccttgggcaagtccttaacctcttacaatgatcagatttttatctgtaaaataggggtagcagagtttccaaggagtttagaggcaatgggtgcaaaattccctgaagatgcctggcacactgtaggacctaacaaaaatcttaagagaatatttatttacccaaacactactgtctaccatggaatatttatttttgaatattttggagagtgttagatatgctatgtgacgacaagcagaaaccctcttggataagacatgagagaggcaaaggaaagaaaactgatgagtaaaatgcttttctgaaatccttgacataatctggggaaatttttgaataatgagattcagggtctctcataatgcatgcagtttgagttgcagaataaactcaaattttccctgtcccataatgtcagaataaactcaaacttgccctatcccataatgtcacgttgatttttgtgatgtttagacaatcccaaagcaactactttttataacacattagagaagacatcgttactctgggtaaattcctcaaactccaaatagaagcagtaaacatgtgagtataaatatgacaatcatttgctaaactgcaacaattttagatattttttggcatgcttaaaggtacagagatttagggggaatgagcgaaaagtaattcaactcatatattctttaccccactttgactaagttttgggtgacgttatcaatttcttgtaaatttggtgtatcatgctatgggaaaggaaaaaaatgttaaaagtttacctccctggagagagggggctggagaagagtgtagcagaaaattatttacggatagttttacatggatacaattgtcatggttttaatccgttgactgaaagattctctagttgtttattttgattagatgtggcattagggccagatttcctgtatttctaagctttcccgtatctaaaatttaatatgtctgtaaaggtgtttaaaggatcatctcaaacatggaaccataatttgttgaagaaaaacgataatcattcttcctgttgggacgctcttcctgtaagggggagtggggcaagtgattttcttattcagatcctggaccaagctcttgtcaacaatgaaactgatctttcctatcaaggccaaagagaagcaagggtttgcatattcaagttcttcatagatgcctgcctctataataggacattcacatctggcagagctcttatgggacacagagagagaacagaagagtctaaaaatccggccaacatctcagtgccagaatccaagttctgaacacaaggctgaatatgtatctggccagtaagaagacactcttcagaaaaaggctgaaaaaacagtcacactccaggtctaaatacaacctataacaaaacccaaatccacatgcaaacataccctccattgcaatgtggaaagagatttggttttaagaagaatttaaggaaattatcattttgctgcaagagaagaagaaaaagatgttgaggccgctactcttgctgtgaaggttacagctgctttgaatttgttagaggaaattaccctaatagaggaaagaggccaggcaaatggtctttagttttagaccactgattgttgtcgagaattattccaaaaacttaaattctattttaaatccttattgtgaaaagacagccatattttaatttttacttatagttaccatcttcatccttagtaatctatagcttgagcagccctaatccgaaaatctgaaatccgaaatgctctaagatccgagattgtttgagcaccgacatgacgccacaggtggggaattccacacctgacctcatgtctatgggttgcagtcaaaaacagtcaattaaaaatattgtataaaattaccctcaggctatgcatatgaggtgtatatgaaacataaatgaattttgtgtttagacttgggtcccatcccagagatatttgattatgtatatgcaagtatttcaaaatttgaaaaaatctgtaatctgaaacacttctggttccaggcatttcagaaaagagatacacaagttctgtactgagttattatggtttaccaaaatttggtatacataaagcaaaatatagcatgttccccaagctcttgcagaaaagtaggaatagatgaagttgagttgactactggatcttttaccagaacaaatggccttctatcaaaaaatgtttgcaaactcctgcgttagacagttctttggtgatccatcagtattgtctgaagctaagcattagtatttttcaaagttcgggaataatgtacttggatcataaggctcattccaacatgccacaggtgaagctcattcattatgcaatagtgaagcagataagaagtaatgggagacaatcttttgcctttcaaaatattataagctctggattttcataacagagttctggaacaggtaagtgatttgtcaagaaaggcttttgtaagccatgttgaaatggctgtgcagtaagtgaacagcctctatctttgcaagaaattaacagccacaccaacctcttgctctttaaagatattagagagaaagcctatcatcatctgatcttggaactgtttaatggattttctctctagtagttaaattgaaagaatgatgctcaggtctattgttttctcttgggaaaagccataccaccctggttggttctttcaaccctctcctgacccaaggatagagaacactacattccaagacatcatgagtgcccctcactctcatctttgggaaatgaggagcagcatccattcaaagtgcagtcaaaggtaaacctcactgccaagtttccctcaagctgagaaattggatgtatcagaaagggtggagtttcaggacttgctctaaaaataatgtgtctggatctcggccaccatcttaatgctcttcctctctaggccctctccccataaatgtcaaatgtggctgtcagtaggttgagcctgaaaataaaatcccctcacttccatcaagaaatagctccaaacttagagtgtgtgctcaaaatattcatgatgaaatcataatcctatatttatagtcttttggattgtgcatgaaattctgtttcccatggtggttttcgttgaagtgggcacagagtgaccaagaaagcattagctgcagggaaatgctgttccgtatcattctgaactggttggttgtgagacaccctccctcttccctgtgccctacccgctgcctgatgagttgggtctaccacccaccccattcccagcaggtcccctctttgattggtcctgtcttgtcctccaagaagagctggccttccgagaaggaagtggggtgggtacctaagattattcccctttcctctgcatctttcctgtcctagacttcctccccgttctcactgagggagatggtgtggaccttaatggttggaacttgatggttcttgtcaaggctgggggttgagggccctacacagcagcagacctgcaaaaagcttttacttctcacccgggctgtggtacaggaggattggtctttggacactgtaatcctggcagatccacggggcatggaagagaaaaatttccattcacaaacgccatccgtcttggagatcctgtagaaggtctctcttgatcccacggggatgcgcaccatgtccttgtgttgcccttccacggcctggctgggcgggtgcagggtgtagcccagggcatgtttggaagactgctttctgcagagacactggattctcaagacattctgaaaggcctttttgaactcttggctggagcatgggtatatgatggggttgatgcagctgtttagatatccgagccaaaatactattttaaaaactgtttcagagggcttgaaatcagggaagaaagaccctggaagaaaacacacagatttatacatattatttgaaagccagcaagccaattggctaggaaaacaatcaaacagacatctttctgtatttttaaacggttaaaatgatcccaaacacatatgagtttctcacatttgactgactagctcctatgactgtcacccttttgcaatatcttcaaagaccattcctacttggtccgcgtgtgtcattaattacaggagcaggcccagtgggtagggttgcactggctctcagtgaccaacagctgctgtgaagttttaccaaatgaaaatgtgaaactcagactgagtccacatatgtaaattgttttgcctaaattgaaaagtaagttggaatccatgcaagtaatccatattaaaattcggttatctgaacatgccctttattctctgatgcagtgttatgcaacagacacagcctcagtgtttatgaattcctcccctcccaaatgttagaattatggattttgatgagaatctcaactttacacaatattggccttgccaaagttgggccagtgattctcaatcacttttcctagatgatgtcttttgatgtcaccgttagctccctttgtcaatatccctcgatgtctcccaaatgtgtgtctttgcttcacattcggagtcctccacagcctctggtctaaccagctttctaatatgactagttgctattttttctctagccagactcactacactttttctccaggtcattgatcattttttttgtcctctcaagttgggccactgtgtccttgatgcccttttccaccttctctacctacccaaaccctacccgttgatgtgcacggcaggaaccaggcctcaggacccgtcacatcctgcgcagagactgccacagggcatttcgcagcagaagaacaaaactgtgaagtcttaaaatggaacaaccttaaggattatctcctccaattactcaatttacaaatttaaaaaatgcttatttagccttttcccagctgccgccaagatgctctgcccttctgagctgaggctgcgttggggtcaggccctcactgcatccagcactagcactactccgggcagcccagccttgcacttgtccacaccacggactccatctcagagctcgcctgcactgactcagccctcattctgtataacgctgaggggatcatcacataggataaggtcaatgtcgtttctaaagcagctggggtaaatgatgacggcttttggcctggcttgtctgccaaggccctggccatcgtcaacttcgggagcctcctctgcagtggaggggcggggtgggaagacctgctcagcagctggtggtgtacctgcgggaggtcctgcccttctgtcactgtggcctaggccgagaagaagaaggtggaagcaaagaaagaagaatctggagtctgatgataatatgggctttttttttttttttttgagtaaacctattttataacacgttcaataaaaagctgaactcttaaaaatgcttattaaagagattgtcacaaacctcatagctacaatactgataagagtgatggataaagggtatgggactcccaatccaatgttctttattctctgattctcagacttccaagggcttttgctaaaggagctttatgaattatgaaatcccaaacgtccctcttcactcctttcagagaaattgcaaaataacatcttgactttccttccacctcctttcttttctttcttggctcccaagctccttttccttctccgcgggcttttagtcacagcttcgtgtacagttggtagaatggctttgggaaactcctatgatgcctttgggcctccagttttcttatctgaaaaaggagtatgttgaatggatgattcctaatggccctgaacaatttttttgttgctgttgtttcaaacctaaggtcttgattttatgtctttcttttcctctctgctctgtggacctatcagagccgtgacaaattgctggtgctattaaaatccactctggcaaacagtgctctgaaattaagtcaaaaagctcatcaatataaacaaagagtaaacttaaatactgaagaacccaaagaagacacaatagtgtggttgttgatgggagcatttattacctctgaagcacactccctgctaagttccatgtgtctcaaattcacacacacacacacacacacacaatgggtgtttatttggaaaacatgtaaagtgagaaagttttattctttagctctaaagcttttcatgttgtcctataattataataaagtttacagtctttgaatgcctgatttgaaacaggcaaggcactgtgctgaacactttccatatgatttaatcatcgttagtaacatgaagagttatgtgactcttccctattttacaaatgaagaaactgtggcttaatgagtttgagtagctcaaccgaggtcactcacatagttactggtaggtttgaaattaggcagtgtgattgatttcagggcccatgctcctttgtggaatctccaaatatactgcaataatacatctcttaggaggatagctgatggggagtgataaagtgtgcagctgggggaagctgaattggaaaaatgctttttcgaacctcatctgtgatggaaaaaatggctaatgccaacatgactgatggttttgtgcaaatgcggtcagttccagaaaaaaatttgtcttacattatgaaacctatatattgtccaatatttcctactaatagtgacagtgatgtgattaaggaaacccatttcacaaagacctgcctgggcctgtgcttaatgactacaagaatgtctgagctgagcacactgaaacccaccttgtctgggaatgtcactactctgtaaatcagcgagggaggggagggtcgtttccttatttgaagaatttcaatttttaaaaaagaaaaaaaaatatgcactatgaatgtgaatgctaataaatatggtttgagagtcttggaatttcccataattccttcaattacactcattctgcttacagaacccagttttgcactcgtaaatctcaacatttccttttagtcacttccttcccatcccttctttccttgcgtggccctgctcttaattccaggtatggctgacccagagccaagctcttgggccctctctctagtctcttgctgtgttccagtcttcacaggtgaatcctggcctccccctctctgtaccccactcaaaacactcatttcttcaacatggctcaggtataggtatagggtgagaaagagagttgattaaaactaatttacactaagatctgaatgtcagataatctctaggcctaaccccaggaatattttctttttaatccaagcaaatctctagattttggcttatgcttccagaccagagaccttcctgtaaatgacaatgtttggtttatcctattaagtgtgtgacagcagccagatgtgtgtaagcctagcacggatttgcatgctcccaaactgatagttccaccaggggcaggttgcaggatccattctcatgcttggagtattcttcccttgtgatggggaacaggtgctgggagccatgtgattttctttgagcagctgctgactggctggggttagatgagagactcatagctatgcttccttcaagaactttccaaagagtgagaaaagacagcaaaagggctaggcatggtggctcacgcctgtaatcactgcactttgggaggccaaggtgggcagatcacttgacaccaggagtttgagaccagcctgggcaacatggtgaaaccccatctttactaaaaatacaaaaattagctgggtgtggtggcatgtgcctgtagttccagttactcaggaggctgaggtaggaggattgcttgagcccgggaggtagaagttgtagtgagctaatgcgcaccactgcagtccagcatgggcaacgggagtgaacccctgtctaaaaaaaaaaaaaaaggacagcaaaagaactgctcctctccttattgacattattcccatccacgtatttcttcctttatttttcctctcctagaaaggagagatggggctggaattgggcttggaaagcagctgcatggccccaaaccctcctcctgctctctctttctctgcccaaaccttccccgtctggttctattttctctgaactctgcattagttctatcctcagcctccattcttcccaaatctctttcttcctgaggactggctatgtttttagggtgggaagacagctggagaatgcttgttcctggcctccagccatcaggacctagagggtcagggctgaaccagcctggttcaggggtgggtgcctctgacccagtcactctgtggggaagtccattcgagcagccatccggccggctttgctcactcacggagctccagaatccagtaaaatgctagagtcttgaaggcattctcctagtttttgctgcatgaatggccgaccttctgacagacggatggactgactgactgaatgaatgaatggctgtgtctctgtgttcttgccatggttcttcttcacagtgtggcttggttttcttttctgcgtgatggctgtagcctcatattatctcccaaccctgacttctttctgctgtctcattcttcttttttttgcccaccatttcagttcagtcatttggtttttttgtaatgttattttactaccattttttccttgctctatcatctggcatcagaccctctagtttttctcatgatgcttcataggaagagccagacttccaaatcacccacatgagaataggggctcctacttctttggtcaccgtagctatggttttctcctcaacaatctctgcttcaagaagagccaacagctcctgacttaatcccctgaacaccttgccctgcagctcaagccatcctttgcatgtgaatttgcctggtttaattcttgggctttggaaaatccccacagcctaaggattcttcctgtcactgagtttctttccaccatttggtctgctgcagaatttctgcctctttcctgaccctctggacaccctgaccaacttacgccggtcagactgaggtggatagaacaggagtttatggccaaacaccatcaacattctcattcatggagattcagaatcctcacttccactgtaaaggcctctagatgccaagaagaaattgaaacgaataatttaaaatgttgcctctatgtctttccactgaatgctatatccattgggaaaatctgacttcatttttgaactggggctcatctaataggcttatgagggggcactaggaggcatcccagtaaaggcttggcgactagagtcaccttttacagttataaaattacagcaacatttgcctcaatggctccaatacaagataaaaccattttttcctgcccatgctggtctcctccatgaatttgatacaccggtgagtgctatggttagcttcaaaagttggtgagagtaggaactgagttctcgaattcctatccagcactggtcattagggggttcctccttagttcaactgtttctctcagaatgagggtgacttgatatggaagctgaaagctgtgagtcagtcttcttggttccagcctccagcttctgcgcttcattttaccccctggaaaacttgacatcttaatgacaaccttgagagacactgggctatggtaaaccctacttagctggagttgcataaggctaaaatgtgaagactggcaggcacttagagatcagagctgtcaacctgtcctttatatgtgaagacagcaaggctgaagacgcgagtagttcccccaaatcacacagctggacccaaactcggctccacctcacccatttccactcctgatctttgtgtgccgtttagcaaccctacgatgacatggaagtgttaatggcagtatgtccagctttcactgaatgacaacaggttttgcagagataaggagaaagaagagaggggagtagtatcctcaataattgcattattttaaaagtcagagtgtgctgttcagaagggtttgtcagcagggccttacattctgagaaatgaagtttgaatgatctcaatttaaaaaaatgtggactccaaagaagaagctaatgttacatgaccatgggagaaaataatctttaattgtttctccttgttcagcgagtggtctctccgatgtgcctggtacacatccaatgagcagaggagagagacaggctgccacaccaacaggccaaggagctccagtgccagtaacattcaggccagacccaatggctccttcttaccaggaagaaaactgccccatcaaattaaaccccagagacaagctatagagtcaaagtttaagagcagaccagagtctaccagatgcctttgtgctgaactactttggcctgaaccctcctggggtttatgtggggccacttgggcagctctcagtcagcaagaagtttttagattatctaccttagatggtgaccagggctctctaagaaggtggtcagaataaccatggacagtaaccttaggcttgcaacctcaggttcacagacagacttcccatgactgacatgaaatgtgtatgtccagagatacattttcctgggaagagtccttagcttgtattagcttctcgcagtgctctctggtgatggtaaagatggttcagcctggatcccaggtagagaggacaagctgtaccctggctggggaacctcacttagcctgtatgtcctaatgatagaatctagcttaccaacagagcaagcagatgtgatttcggtgcctctttggaaggacttcgctagtctttttttcccctatttaactggggcctgaaattgtacagctctccattcatgtatctgagtaaagtcatgtgtatgctcacttgagagtgttggcatgtggagtcttttctgaactttctggcagaaaacttgagtggttggtaaagtgaggaaggtggcactgagcaggaatggaattagctctcctcttgcatggggcaaagcatgggagcatggcatgggagggtacagtgagtaaggggaaccgggcacactgtgctgggcacacatccccgaaggagacaggctcagggcaccctgggggcctgcccagtgtgggatggaagtgctgcccacttttccagggactgaggcacgttggtctatggttactgtgaaaaaccattgctccttccaatccaggcaaggaaagaggtcacttggggagatgtcctctcatccctcaaacttctgcaagtggcagctaaagttctcttgacaggatctgtctggctggccaaggagagctctgaggaatcaggaatttcatcctggatgagtctgagctgctggaattaaaacttgtcaaatggttcgtctcaccagttaacaaagcctaagaagcatttctccttttaggaaaaaggagcaggtccacccaaatgcatgatttggaccccaacgcccataagaacgctggaaagagtaataggggaccccacatgtagacatttctccctagaagacctccttgtgtccaataaataatttgatttgaaacactctcagaagatagcaagattctctaccccactccctttatttaaaagattatttgttcaggaaaaagctagcaataaggaagtcatcatgtgcttttatgggctgcttccttaaaagcagatctcctttcataagccagtgtattttccaagccttgtcaattttactaaggtcaccattgtttcatgagtcttccatttaaaacatttttataatataataaccaaaccaaatgtccaacaatgatagactggattgagaaaatgtggcacatatacactgtggaatactatgcagccataaaaaaggatgagttcatgtcctttgtagggacatggatgaagctggaaaccatcattctcagcaaactatcgcaaggacaaaaaaccaaacaccgcatgttctcactcataagtgggaattgaacaatgactatacttggacacaggaaggggaacatcacacactggggcctgttgtggggtggggggaggggggaaggatagcattaggagatatacctaatgtaaatgacgagttaatgggtgcagcacaccaacatggcacatgtatacatatgtaacaaacctgcatgttctgcacatgtaccctagaacttaaagtataataaaaaaaatatatatatatataaatttttttaattgtctctgcacaaaatctctccctgagaccacccagtctaaagaagagtaatcttcaaactcacacctgctgaatggcttatttatttcacggtacatatcacagtttttaagttttcttatttacttgttttctttgattgtctcatcctccagagcacagatgatatgctttccaatggtaggagaccaggttatctctctcactgtagtgcaagatgggagcaggaacccaattaacagttcctgccagaagaatatgtatctagttccttctcccttttttttgcctcttacattccaactggtcaccaaaccccacaggtgtctttccttgaaacaccttccaaattttccttctccatcacctccaaccccagcactgctgcatggtgaactggttgtttaaagctgggtgagtcattttttccttcttgggcctcagtttcctcatctgtaaaagtaaagacttagaacagtaattgatgctaccccttcctatctgtaagagcagatgcttctaggcaaatggaaacagtcaaaaggggaaaacagcccatgacaagcaggatgatgaaggaacgtggtggagagatggccagaagggaagagggcaggctttggaaggaagaggggaaactgaggttttggggaaggctttgggaggacaccctcatgtctatcctagaggtttactttgagatcacggaaaggaggggtgggaggagaattcaaaggctgctgtcatgcagtgcgtctgcataggggcccaggcaattctgattgcatgaagcgggaatggaattagctctattcctgcttggagcacagcacggtttgggctgctggtcgcgtcagaacttgtgagcttcttaataatacacgggccacacacctccacatctgaggcctgggaggctaaggctgtgctcatctggtcctttccaaggagataggatggaaagggaagaaaccatgggggaaaattcccagaaataactaaagggaggggaggcttatcaaggggctcagtattgtagctaagggaacctcataatggggtatctgccaagacatgtgttatgcattatctttttgttgctgataagatcaagtccaagctcctcactctgtcattcaaggcccctttattatttggttccaccagccctacacaaccttcttcattcctcattcacttaacacataatttacttagcacctgctcaggccaggcacttccatagatactggaggtagaatggtcaggaacatgcaaaggtgtttaccttctatgagtgtctccaacaaatgcctatgttggaggcatttgttgttccaacaaaggaattatgagtttccaacaccaaggctttcttcctgccgcagtagacttttcactctaactttgttagttcacgaggtgactgtgacctcagctcctgtggctgttttctgctgcactcttctgctcttcactcagtgacctctctcccctgtatctactcaaacttgaatttgtccaattctctctgtcttcaaggctgttttcaaaatcccactcatccacgagcccttctttgttacagtatagcttgctttcttgccatttcccctgtggatttagcaccagtttcttttctttatagcagggaaacccctgggccacagaccagtaccagtctgtggcctgttagaaaccaggctgtatggcaggaggtgtgtggtgggccagtgaagcttcatctgtatttaaaatttacagcctctctccattgctcacattacctgtcagatcagcagtggcattagattccaataggagcaccaaccctatcgtgaactgcacatgtcagggatctgggttctgtgctccttatgagaatctaatgcctgatgatctgttgctgtctccatcacccccagatgggactgcctagttgcaggaaaacaagctcagggctcccactgattctacattatggtgagttgtataattatttcattatatattacaatgtaataagaatagaaataaagtgcacaataaatgcaatgcgcttgaatcatcctgaaaccatcctcccatctccaggcccatgaaaaatttgtctgccatgaaaccagtcccttgtgccaaaaagattggggaacactgctctatagcccttatcaccattttctgtgctttacttatttctatttttggttgcttttcttgactataaactcccttgaaggaagagcttcctgtctttttaatttactgctgtatcctcaacactcataatggtgtacagcatttagtaggctcccaacaatattgctgaatgaatgacacattcaatcctcctggttttagtctccttaaagatacaccctccttcttatccttcattcgtgtctctctaagtgatcaacatgattctcaatgaatgcttttgagccaatagatgacattggttgatggaagaaaacaacattttgaacacagctcctgcttcaattactcacagctggagatagattctcaaatgcagaaacagagcctgtcttaactcacattccaaggagatctttcagatcttcaagacactcacatttatgtgaaaacaagaccattctccaagtagttttatacagctaagttgcaggcacttcataaaatgattacttccagtacttataaaaacattttatagggtcctggaagaagggttgaagcctataattcagatgtgatagtcatcatctcctctcatatttgtgggattcaagtccaaggccaaacaccacacatctgaagcagtgacacaaacaaccaaaactgatctcccaaggaggaagtgtgaggctttttcaggactgtgtcccttcatattcagcttaaaggctaaagcaggtttaggtcctgatccttgccagaaaggacacaggtgagttggctgatgcttgaatagtcacaggtgaacaggggagcaggaaaatgggtttttgcttccggactgctgcaaagatgcttaatctgagtgctctggacagttccgggtcctctcccaggccactggctcacccagaggcatggcccttgcatcttccaacagcatcttctagctttgtgcgaagcaggaatatgaataaacccttgctcttcactcccagctcctgtgcagctccctcccctgcctggattaagctagggatgaagattggctataggtctctgctctttctccccagccacttgggtaaacagtcctaggctccatctggactagaacacctgaccagggcctgacctctatcagtcatgggtcctgtattcaaatggacataatacatatatataggaattttaatagctcatttaaaacatgcaggatgtctttttggaagctataatatggcttctaagtatagctgggcagaccaaattttaacacgcagaaagggattggggcaatttcctctttaattttaaaaggcaatagagtatggtactgttttgattatagacatttttgaaaataggaattggccatgccttcctctttcatataaatgtcacatttagaaatctcagctttgcttgcaagagacatccttgctcttttcaaacttaatgaagccttctgcattctcatctgagaactggctggtactttcagggggaagatcaaggtcagggcagctcattcatttcatacctttagtttctttcttttccctatgacttgcaaatctctatgcctagaccatctctgccacctgagctccgtcctgcacacacaactattaccagacatccctcctgatgtttccaaactatctcatccttaacatcatcaaactgaattcaccatctctcacaaaaccgactcttgcttctctgcttcactttgggcagccttcctctcacttgtccaagccagaaacccactgtcatcctcaaccgtccactctccaacctcttccacaacatccaatcacccagccctgactacgaaacctgtattcacttgttattgtccattccagttctggccaccaccacgtctagctagaacctcatatcagttttctaactgggcttcctgcttctggtcttatctgcttccaacccatttctcacactcttgccagagagattctgagaaagcaaacatgacactatccctcccttgagtaagtcatttcaatgattctttactgaattaaagatgaagtatgagttatatatgaaaacttattaggcccgggagactgaaaattcacttggctggataagtaggtagtagagcatggtaatccaagtgcccacccagagactctagtcagtgtcatagaagagcagagaattacatcctccaggatgtgatcatttgcgtgactgttaactcagctgagcgatgtggcatcttttgttcactaggatgtaggttagggttatagtggttgagatatcagaatttaattttaagaaataaatatacgtctcctataaggcagtgtgtccactaaaaaactcttccgaaggccaaagaatattcagaatgagtttccaactgttccagagatagtggtgacaatgattcagaaagttttgtaaaacctggaagacccaagacaggcataaaaatacctgaaggatcaacatgggaagtggtaaaaataccatttgacatagcaatcccattactgggtatatatccaaaggaatataaatcattctatttcaaagatacatgcgtgtgtatgttcattgcagcactattcacaatgtcaaagacatggaatcaacccaaatgcccatcaatgatagactggataaagaaaatgtggtacatatataccattgaatactatgcagccataaaaaggaatgagatcatgtcctttgcagggacatggttggagttggaacctgttatcatcagcaaactaacgcaggaacagaaaaccagacaccacatgttctcacttataagtgggagctgaatgaacacagggacacaatggggggaacaacatacactggggcctgtttggggggtgtggtgaatgagagcatcaagaagaatagctaatggatgctgggctcaatacttaagtgatgggttgatctgtgcagcaaaccaccatggcacaagtttacctatgtaacaaatctgcacatcctgcaacatgtaccccggaacttaaaataaaagttgaagaaaaatagtcaaacaaagaaacaagtgcatttgaggctgtctcagaaggactaatccctggtacccgttgtgattttctgtgacctcacaccagccatgtttctaagaaaaagtcgtttcccgctgtcgggattcccctctgaaatgctcacccaatatctgctccaattaggtgattaattcagaacatatcagatcaccaccaataatagtttctggatgtgctgttagagaacaatagtgttggtcagcaatctcagcacagatgtactaattccccaggtgggtgtggaagcagtaaaacttttactcaactgtagttatcaatttctctctctctcactcacagaaaaatgttcatgagaagaaaagaaagctgacacagttcgtcaaaatgaaaataatgagactcactattgttgtttattcagatttgattttggagagttagaagagtttctatctcaagataggaattggtgttagcaagtgactgccttcagaatgtgttagaacctggggatctggcatgactctattttcctaagtttttcataaggcttatactatctaagaataactaaagaagaaggctgctagggagaccaaccaggaggctagcatattggtttggggtcagagctctaaccgatggctgaaagctataggaagactgatttgggctgccctggaacttggctttaccatcaatgatacatgaaaagtatctcagaataggcgggatacccactcactgaggccagagactggggagttaagtaccacacagcatcctattaaaatactctttaggggacatttaaatcctgaaattttacaacttattgagaaagcaaaaattattggtggagagaaagttgattgttttttgaatgttgaatgaatgaatgttgaatgaatgaaaaaattgaatgtcttgcttcccttttaatattgcaataaggtgtacattagaagcattttaaggggcatatatatataagaatatggatatattattggacatgacaacttatttagcatgatttatctgtttctgagaatgagactagtctatatgtatttcaataactcctaaattttctccatttagcattcattacacacattttgatctaatttgttgttgaagccatttataatcacctcatataaacacttaaggcaacaagagctgagctgacgtctggactacaaatacgcaaggatgtcaacattcagaaaagatcaggaacttgctcagggttacacagccagtgagcaaaacgactaggttaaaaactctgttcttcagatttccagtttagaaatctttcttttaattgacacattgatttttttttcaattgcaagagtagaaatatcctccaattatttgggggctctcagaaaccctactctaaaaaaacatgaatacattcaagctgagtatctgcagctagcattcagccatcaagcgagtggcttcagtccttgcttatttcagctcatgattcatacatgcctcttcatgtaaatgtctcacagaaacctcagggttaatgtgttcaaaatgacacatgctagtctgcttgattctggcatttcccatctttataaattatatttggtattcactcactgttaagaaaaagtgacaatcagtcctgatgtcttcttgacgtcttcagtagatcagaactcctagtattgccccagtctttccacgtctctccatctccattgtcaggccctactcagccacaacacctgtcacctgtaagtgccttcttgttgatctcctgcatgcctgggtcaccttcccttttccctaggatgacctttatggaatacaactctaattcggtgacatttccacttaaaggcctcaaacactttccagtactcttagatgaagcccaacgtccatagcatgggccatagggccatatgatctgctcttgccttccgctcctggcctgcctttcactctcttccctatcccctgctctggccaccctgacctcttttttatttttatttttaaattttttttttttgagataaggtctcactctctcacccaggctggagtgtagtggcgcagtcttggctcactgcaaccttcgcctcccaggctcaagcaattctcctgcctcagcctcccgagtagctgggattacaggtgcacgctactatagcccagttaatttttgtatttttagtagagacagggtttcaccatgttgaataataagactcattattgcaagagatgtactccattgagtacatctcctgacctcaaatgatccacgtgcctcagcctcagcctcccaaagtgctgggattacacaacctgatctcttgatctatggaatacttctctgcaccaggcccttcacttctgctcttctccttgcatggagtgtcctctcaacctctgtcccctccactcaccatttatatcttagcttaaatcacccttcctcaggggaaagatctttgatccccttccacccatccatatacctcagactccatgctgggttgggggggggggtctctcattaaatgttatcaaagcatcctaaactttttcttcatagctcaagcaattgttcttatttgattatgtgggtgatgatttgttcaacatatctccctatgtaaatttcataaagataggatttgtgcctggtacattgtagttgttaaataagtattcgttcatggataaaatatttatagagcactcattatgtggcagacatcatgcaaaatattacacaaacattatcccatttaattctcccaagaacatgatgtgactgtattaccaacctcatcttacagatgaggaaactgaggcttaaggagtttaatttgcaactaaggaaaatagctgagctcagattcaaattcaggcttcatgcccaaactcatgttttaaatttctagatgatgctatctgcgaatctgtcactgctttgctggctttatagtgaaaatagtgcacagagccatagtacttgaagttcaaaacaaagacaatcatcagaatagccaagaaaattaatcacacattccatgtcctattttttcagaaagcagagacatgtgtaattcaaattattaatacaaaaataaaattctcgaatgttaataattaggtttgttcagaatagacatgtttggacatggaaaaaaaacccacacatactatattctgtctgaaaagactttgacaaaatgcaactaataaagtacgcctaaaaaacaatcaggtaagattggtcagaaagtatgatctgttatgtatgacaaaatctgggtgaaagtgtaggaataaaaggagaactgtcatctgtagttcttggatatggagagaagggaaaagtgaaggagagatgataacagaaatagttaccatctcgtgtgctgcataaaaatatcaatgcctgacacagacttcttagttcttagtacttgttccccagggaggaaatcccgacagctcacttggtagttcagggatgagggcaagattgttcccttttctgtgcctcagtttcctggcacacgtaagttcagtgtctggctgtaagcatttgctcatttgctatcccagagctatgatcagtttccttcctctgcatgtagcagctctgcatctactttcagggtatcttctcagtcattagtgctatcttgtctatttttttttttttaacatttggggataatttccaaggtcagaaaccggacattgagtacatcttcctgcagagatgcccctggatgtgtggttctggtttacacaatggttacccagatgccacacctgtcagctgctctgagaatccccaagtatttcaagagaatttctcttattcagagtgctggggaaaagacatattcacagagaaatgtgctcacatttcttgcatagcctgttgtccaatattacctaattgtggctacagaaagataaggtataattttatttatttgggatttttttcaaggctaagttgaatctaatcaggtaaataataggtgtgtttctacaagttgtgctaagtctactctagagctgaggccatatgtttattacataggatttcttgctggaatttcttccatggatacctgggctttctatcacatctggcactttgtttcttctttttgtcacttttagagaaaaagcctcccagaaattagacataatttttgaaaaagagttagagaagtttttaagtttcatgatctcataacccatgtggagagttcttcctagcaccatgagggtgatgatggtggcactaataatagtaattataacagtagatgtaatttattagtaatttcaactgtccagcaatgtgctaagtacttttcatgcaccacctcatctcctcatatcaaccatgtaaggtaggcattgtttatccccattttacaaatgaggaaaatgagactcggggagtttaataatttgccaaaaaacaatcagccaataagagtgaagctgggttcaaacccatgcttgcctggctccagaccctgtcctgtacctgctaacaccgaatgcgctacaacccactgcctggtttctctactgctgtatagtgctgtgtgcttattgccaaattttcactggcaaaatcagatcctgatttagacaacaaaacaaagcaatttgaatcaattattaagaaattttatggttaaaaatatatatttttaaaattttactttaagttctgggatacatgtgcggaacgtgcacatttgttacacagacatacatgtgcaatggtggcctgctgcatgcaccaacacgtcatccaggttccaagccccacatgcattagacctatgtcttaatgcccccattccccttttccccccacccctgacaggcctccaggtgtgatgttcccctaaattgtttttaaaaagggtaaaattcatatggaaccacaaaagaccccaaatggccaaagcaatcctgagcaaaaagaacaaagctagaggcaacacactacatgccttcaaaatatgttgtgaagctacagtgatcaaaacagcatggtactgatgtaaaaatagacacatagaccaatggaatagaatagagaatccagaaatcaatccatgcatttgcagctaactgattttcaacaaagctgccaagaacatacagtggggcaaggatagtatttttgataaatggtgctgggaaaattggatatccatatgcagaagaatgaaacttctaaactcctatctctccccttatataaaaattcaccaaaacagtttcaaaacttaaatgtaagaccaaaaactataaatatactagaagaaaatataagggaaatgcttcaggacattggtctgggaaaaatttaataaacaagacctcaaaagcacaggaaacaaaagcaaaaatagacaaacgggattatatcaaactaaaaaccttctgcacagcaaaggaaacaagctatgcatctgacaacagattaatatccagaatataaacggaatttaaactattaaacagtgaaaaatgtgataatccaattaaaaagggaaaataatctgaacagatatttctcaaaagaagacatacaaatggctaaccaatatataaaaatatcacgaatcatcaggtatatgcaaatccaaaccacaatgagatatcttcttaccccagtaaaaatgtcttcatcaaaaagaaaaaacataacaaatgctggtgaggatgggaagaaaagggaactattatacactgttggtgggaatgtaaactagtacagccattgtaaagaacattatggtggttcctcaaaaaaccaaatacaagtagaactaccatgatccagcaatccagctactgggtatatagccaaaggaaaggaaatcagtacctttaagggatctctgcacttctgtgtttattgcaatgctattcacgatagccaatatatggaatcaacctaagtatttatcaaaagatgaatggataacagaaatgtggtatatatacacaatagaatactactcagccctaaaaaagaatgaaattctgtcatttgtggcaacatggatgagcctggaggacactgtgttaggtgaaataagccaggaacagaaagataaataccacatgttctcactcatatgcagaagctaaaaaagttggtctcgtagaagcagagattagaatagtggttactgaaggctgggaagaatcgtggggagggggatagggagagattgggtaaaggatacaaaattacagctagataggaggaataagttctagtgttctatagcactataagatgactatagttaaaaagttgtgatatattgttggatggctagaacagtttgaatgtttccaacacaaagaaatgatcttataaatgtttgaagtgatggatatgttaatcactctaatttgaccactatacattatatatatcaaaacatcactatgtgccccataaatataatatgtatggttattttgtgtcaattaaagaaataaaataaaaataaattgttaaaaacttcctaacatagaaattatagtgactttctctttggaataagtttgatctatattcaggcaccaaaacagtttgaagaaggtcatagcaaccatgtttaaaaattactgtgtcttttaagatacaaaattaatatatgctaaatttttacaatctgtggtatccacaattggtatgcctcccatgcacatataggtgcatgtgtacacacacatacacacactcacacacacacaatacaaaaatcaaccatgatgctacaatctagaaataagaccagattttaaacaactatgattgtatttagagcacatgctttttaccagcctttatgtaatatgtcatgaacattttgctattttatttttattatagaacacaatttttcatggcatcttagtatttcattgcatgaatataacaaaatttatctacttctgctaatttgaatattttggttatttccagtttcctctattataaataactatgaaataaatatttgtgtggatagatttggagtattttcttaagttacatttctagagaaagaattctgggtcatataatataaatttcataaggtttttgatccgtattgccaaattgctctctggagaggctatacctacttatacttatccagcagtgaaaagtaatgacagtatggcgatgatgatggcagtaaattatgagtgcccactgggtgctaaactcctagagcttcacatgcagcagctgatctaattttcccatgtgttcagtgaggttgggtgccacgaagcctgttttatataggcaggttttatctgcataggaactaagaaagacattcttgccaaagactacaagggtctgcctgacctggcctctgccatttggtaagaaaacatttaacagccatgccaaagtgctttttacttcttaaactgcccagattttcctaacaaagcttttgtattcattcatgttccctcttcttgagatgttcttcccttgggtttgcaggtctagacctttctcttttatgtctcagctcagaggctgttcagtgaggctgggtgccacaaagatgcattttctaaacatgtaatctaaaggatacttctgtccctacttcccaatatccctaacaccagcctccctatcacatcagcccactgtatttctttaatggctcttgtccttttctgaaacatttaaaaattgtctgtttcacttatgaaatgtaatttccctaaggacaaggagcactagaatggaggctggtaaacagtaggaatacaatacatgcttgctggctgatgaataaatgcccatatgaaaggaaagctacaaagcagccatcaggattggaacccaagtgcgcttttgaatcttgctttaatcattgcaatctacagaggatgtctcctatcccaccctcagcagcagtatgtatttatttgctctttgccaatttgataggtaaaatatgatatattttaatattttattagttatttgtatttctgcttttgttaattacctctgcccattttttccattagttagtcatcttttctcattttttgtatttatcaatatttgtattagacctctaaatatatccttgccaggtaagaaaacaggtagaaaagaagaatacatgattaatttgatagatgtagaaagacattaagtagaattcatcaccaattctggataaaatcattttaatgcatatagactggaaggacattctcttagtagcacaaagaagacctgtaagttccatcacaatatttcacaaagaactaccaaaaacatagacatttaactcagtactttctcactcatgctttgccttaggttctttatgtagtaaatgtttactttgtaagcatcaaatgaattaatgtagacaggaatatatagatcagtgtctggcacatagtaaggtcatatacgttggtgattattgttattaccactatataacataaacaagtaaaataatgagtttgtaaccattcattaattattgcttacatttttagtacatccatgctcaccctttcatgagtaaaattaagtatgaacatgttcaaatatgtgaattacaaaaataaatgtaaatggattaaagtgctgtgttaaaaaataaagcctctcacactgaattaagaaaaaaattgaatatatactgttatgaaagacacaaaagacatggttacaaaaataatatggtttggaaatatatactaagcctaggtaaaaaaaataaactgagacggtaatattagtattaaacaaagcagactccatgacataaagcatttcatggaatagacaggattattttaggttgataaaagtcatgcttaccaatagagccatatttattaaattttatgtaccaagagatagcaaatacataggtatatgtatgtatatttttaaaatgcttaaaaattgataaaattttacttgaagtagatgactaagatacagacaacaaaatatgtatcaagttttcagtttaagagtaaatcaatgacaacttagaaaatactgaaaatgagagcttcatgcaagaagccaaagttattctcctctgtgaagtcttagatggttatatttaaacaagaaagacacaaatagcttaatttgggcattagagtaaataagttggaaaagaactacaaattaaaacaaaggaagcaaaaattaatgaattaaaaagcagaaaatcattagaattaattagtacatttaagctgattcattgaaaagactttaaactggacatgcctctgacaagcctgactagaaagtaagaggaagagtataattgtccatcagtaataagaaataatatattttcagatgctgaaaaaagtgaaagcaatttcaagtaaaaaaccgtatgcagataacatgaagaattttgataaatttgaagatatttgtctaattttattcaaggagaaataatatatgaaaactataatgattatagaagacacaaaaattgacaaaatttatccttagaaactgttggatccaaataatttatattcatgctatataagtattttcagagtctttaagtatgtaaaaatgcttcctaattcactttcaaagctagcataatcttgatctcaaaactgagaaatagagccaaatcaaaagaaaacaaataaaaagtaaatatgaacaacccactgtcaccacaaaacaaacaatcccacagacttgtatcatttagaaatgaagttgaaatacaatgaaagttgtcgattatatctaccagtctattaagtaaaaacaaaccatgatcaagtagggcaggaagtggcaaactttttaagttttattattaaaaacattagggaataatggaataattaacaggaagggaacactttcatttcaaggattgaagttgttacctgaggtggctctttttgtattcagtgatacaccattagattctgcatcattttcatgcaactttatctgtctcttcattgttgtcagaataaattaagagaaaaagtgaaatttaggaggaaagaagcctgctatctctggtaatagatagtctgtgtggttcttctggcctcagaattgtggttcatgaatcttgcatgaattttgggatacagggccagatagtaaatattttaggccttgctagctgtatggtctctgtttctattattcagttctgccactgtagcttgaatgcaaccatagtcattaggtaaatgaatgtgtgtgactgtgttttaacaaaactttatttgtgaacactaaaatttgaatttcatataattttcctgtgtcacaaaataaattctttgtttgattgttaaaaattatttaaaaatgaaaaaattgtatttaattcatgtggccataccaaaaaaaaggaggcaggttggatttgacctatgagctctagttagctaacatctaaggtaggatttatccctcactttaaagggaattaagaacaaaagtgtttcttctgccctttgattattaagaatattattatgaacaagaaagagatgtctaaaattacaattaatgaacaatgttctagaagattaagtcaatttaatgagagaagaaaagaaagcagatataaataatggaaaaggcaacttattaagatgtgtatcctgtgtactataataatttgttacctggaaaacaaacgttgtattttttaaaaaatcttttttcctaactttgaattctaaaaaaactaagaaacaatgatcagggcagttgcaatgaatattccattagattgtgtccttcaaacaccatctcctactaaaaaggaccaagacttcctggagaaatggctgattccaggtctggccaggaaacatacaagaacagacttattgctactggtcaggtggccacaagagactgcagtatcgtgtcaaaagagctaaggaactaacttaaatgaacaaccattggccaatgatgagacaatgtgagactcgataagcattcacaaaggattaaaaatcgctgcaaggattaataatgagtttcaattagtaaaatctcgatgctgggggaaaataaacctttatttattacctttgaaggaaactaataactgccttattattttgaaaactgataagtaaagaaccaggcgtttatcccacctttcttgtaaaatctacacctcagttaatcaaatggttgatgagcagaagttgctccatctatgtgttttcaaactaataaatgaaagtggaatgatagaatatcgccactttgcaaccctaaaaataaaacaaattaataaatttaggcaattactataattagcaatattttgaaaaaaacaataaaacattttttacctcctgatggaagtatataccatctaagcattagttttaccacaaacaaacagacaaagtgatacatccttctaagtctaatagccaacttgcaggaaccataaggaggagaatatattaaatgacaccactgtgatgaagtcagcaaaattcaggctacggaaaattgtttattcaaaggaaaattaaatagaaattccaagaaaaagaaagcgtaagggagaacttgtacaggaaataaacttagacttataaaccattcatactatatggacctgatttggatctcaattcaaataaaaaagttctaaaagtgtcctaagaaaattgaagatatatgataatataaaattattgtcagcttttgtttagatataatagtattattgttatacatttcaaaaaaagagtaatgtttagaagtaaatagtaaaatatttacagatgaaatgacatgctctctagaatttgcttccaaagaacctgagtggagtgagaaatctgaataaaataaaactgcctatgaattagtttacaattattaaaattgggttataggtacatcagcttcattacatgattgtctctacttttgtatgcatttgataatatccataataaatacttaaaatattaaaaaagaataaaagcacataactaaaaaataactcactgattacctacaacatttcgctaccttcatctgcatttccaagtttttttaaatagctttcataaataagtttgctttttaattcatcctgcttgaaagccaaatgcattcagggctgtgaaggacacaaagaggtgggattttgttcccagcctcctggattcattatgaatgaacaaagactggtagaaatcctatggtaattcacagcctacagtaccgtgaagacaaggaggaaagattcgaggacaaatgtatcctacacgtggccgcagagaacagacaccatggggacatatgagacagtggagtggagggtattttaaatgaaggggaatgatgctaaaggagggtcagtgtaaaagtggatagagagatgattaatttcgaaaggggggtacaagatgaagggacacccctgaaatcgggcacaggcacatagatttgataccatgattatcaggcagcctctgtaatgtgtgaccacaggaagcttttgcatatggctttgttttaaaggcagatatgttcaggacatattggagaggtttattccctcactgcgcaaatttttatagagatgagactggaattgagagtgaaatgaagggagtcgtattagagcatgagttctctcagcgttctcctccaaagggtctgcaaggtgaacaatatgttcacaacgatactaaggcagtatttgcctttgccactatcattctgttgtgagagtggagtgaaatgtttcagagatgaaatgatgtgtgttattgtaacagattaaatgaagagcagatatgaggatttagctatcatttatagcctgacatcaaagacacttgcaaaaatgtagaacaatattaccccctcactgttttaaatttggaaaatccagtttgttttaacaaaagtatgttatttatgttaatatgtaatgggtttattatttttattttattttattttatttatatttaaaacagcgtctcgctctgtcgcccaggctggaatgcagtggtgcgatcacagttcacggtagccttcaactcctgggcttaagcaatccccctgacttagcctcctgaatagctgggactataggcatgagccaccatgcctggctaattttttgattttttttgtgaagatggggtctcattatgttgcctaggctgggcacaaactcctgaactcaagtgatcctccagcgttggcgtcccaaagtgctgagattacaggtgtgagccatcatgcctgacctattattgttattttaaagaaattaatatattttttaaatttctcagttttaattttgaatattgtaaatatcaacagagtctacatacacaaaaactctttaatgtcctatataattttaagagtgtagaggggtcttaagaccaacaggtctgggaattcctacatttgagtgtttattgaggctatggagaagggggattcaagaggaattgcaaaggaaaagtgatcatgacatggtgtttacgtcagtacataattgttaagtgctcataaagtccaaggtcttaaacatgaagtagaaggacacaaggtgtcttcaggtggtcaaggtggaggtctgtttgattcagatacaaattctcatctgcatcgacagtaagttagtcttttttttttgggatggaatctcacttgtcacccaggctggagttcagtggcaccatctctgctcactgcaacctccgcctcccaggctcaagtgattctcctgcctcagcctcctgagtagctgggattacaggtgcttgccaccacacctatctactttttgtatttttagtagagacagggttttgccatgttggcaaggctggtcttgaactcctgacctcaagtgatcctcccacctcagcctgccaaagtgctgggattacaagtgtgagccactgtacctggctagtcttgaataacttctagtgatgttccaagtgatttgctctttcagagaattagatgggcgagattctaaatctcactcagaaaagcatggcttttttaacccataaagaaaaaatgctttctcaaaaggactcaatatgttaagcagatccgaatatacttatccctttgcttacacaagtcataaactgtgtcagctctcacctacctcctgcttattctcatttacttttgttcaaaggacatttttttattcctaaattatttccccagacagagatgataattcagtatcttgatgttcatttaatgcatgtgcatgggaagccaagtcatttgactatcaggagtctagtgaaaaatagaactagaatggtatctgcctgtgaaaaagacacaaagtttagagaatatactaaagtttacaaaaagaggattttgggggttatgtaggttaccattattaaatacccaaataagattatttctataagaaacactttaaaacaccactcacctaccaccatccccatgacaaaattaaacactctccttgtgctcccacgagtactaccattttcctctatagtattaccaacatctctgatgtatgacagtttgttacatttctttcttttttctctctctgcccagggatatcttgcagagcaggtattttgctttattcccatttgatttccaacaatcccttacatggtacattctatctagcaagtttcaataatggatgttgaatttaatgaactaaaaaagccccggatgttgtcaagattgcatttgtttatttaatgtatatagttgttcaaaagttcattaatggggtccagttatgacacagtaatgggtatgatatactcttctgctgtaaaaaaaaagatgtaattgattacaatatatgaagtccttgtttttaagcatttaggattttgatcctctggagaagtaaacacatgagatgagctcaatgttactctttctccttcagggcattttctaaattgtggcacagagaagttgtgccctaatgaaactgatctctgggtggagaaaacagaggttgtcacccagggaaactgagatgggtgaaatttgcaaggcaaggtgccacagaggagagagctgtgcagtgacttccagtgaatctgtgtgctggttctcagttaaactacagccaaatatttgaatctgtggtcaaatatacccagtgccagcacagggtaattgcctacaagaataccagtaggtgggttcatttgattctttgaggcatggccttaagctttgccattacttttaaggctagagcaatgctgatctaagatatacttttctggggtctcagctgatcccagattatggaacaagctctctactgtagcttgtttcaccttcaatgtgtcatgtatgacatctggagtctctgttgagtttgcagctctctgggacaataagtgaatattttagactgtatgccagtaaattaaacaaactaaatgaattgaacaaatttcttgaggtacacaaattttcaaaagtgatttaagaagaaagaacatttgaataaatcaatttacatggaaatgcacgtaatctagaattgccaattcaatgtgaaaaaaataaagttggaggagttatgttacttgacttcatgatgtattaaaaagattatcatctgctgggcttggtagctcatgcctgtaatcccagcactgtgggaggctgaggattgtggatcacttgaggtcaggagtttgagaccagcctgatcatcattgtgaaaccctgtctctactaaaaatacaaaacttagccaggcatgttggcgcatgcctgtaattccagctacttgggaggctgaggcaagagaattgcttgaacctaggaggcagaggttgcagtgagctgagatcgtgccactgcaccctagcctgggttacagagtgagactcggtctcaaaaaaaaagagaaaaaatgatcatcatcaaaacaatattacattagcattaaagacagactaatagatgaatagaagagaacagaaactctaggaacaggccaagatgtgaaaaatgatttttcaaaaacagtataaaaataattcaatggaggaaggtagctcaatgggggaaagtcttttcaacaaatggtgtaagagtaattgaatacctatatgccaaaatgaccatccttgaacctagaagaaatggacatattcccagacacatacaacctaccaagactgaatcaataagcaatcaaaaatctgaatagaccaataacaagtaataatatcaaagccataataaaaagtttcctagcaaagaaaatcctggaacccaatcaatggttttattgctgaattctaccaaatattcaaagaagaactaatacgaatcctactcaaactatttcaaaaaatagaagaagagggaatgcttccaaatactcattgtatggggccagtattaccttgctaccaaaacacatgaaaaatcatcaaaaagagacataaaaaaccccaaaacaaaattacaggataatatctctgatgaccattgatgcaaaaaccctcagcaaaacacttgtagtccaaattcaacaacatattaaaaagattattcatcatgaccaactgagattcattctagggatgcaaggatggttcaacatattcatatcaatcagtgtgatacagcatatcaatagaatgaaggacaaaaactgtatgattatttcaattgttgctgaaaaagcatttgataaaattcaacatcgcttcatgataaaaagcctcaaaaaattgggtatagaaagaacatattccaacacaataaaagccatatatgacagacccacagctagtattaaactgaattggaaaaagtgaaagcctttcctctaagttctagaacaagacaagcatgttcactttcactgccgttatttaacatggtactgggagtcctaactagatcaatcagacaagagaaagaaagtaaaggcatccaaattggaaaggaagaagtcaaattatccttgtttgcagatgatataatcttatgtttgaaaaaaatctaaagaccacactgaaaagctattagtactgatttaaaaattcagtaaaattgcaggatacaaaaatcagcagcatttctatatgccaacagcaaacagtttgaaaaagatatttaaaaagtaattctatttacaatagctacaaataaaataaaatacctaggaataaacttaaccaaagaagtgaaagatttctacaatgaaaactgtagaatactgacgaaagaaattgaagaagacacacaaaaagtggagatattctatgttcatggattggaagaatcaatactattaaaatgttcataaacacaaagcaatctacagattcagtgcaatccctatcgaaataccaatgaaataaaataaataaaatttatatggaaccacaaaaaaccagaatagccaaaggtatccagagcaaaaagatcaaaactggaggaatcacactacctgacttcaaattatactatagagctatggtaaccataacaacatggtaccggcataaaaacagacatacagacaaacaaaactgaatgaagaacccagaaataaattcatacatctacagtgaactcatttttgacaaaggtgccacgaatatacactggggaacgaacactctcgtcagtgaatggtgctggggaaaccagatatccatatgcagaagaattaaaccagacccttatctcttgcaatatacaaaaatcaaatgaaagttgattaaagactatgaaactactaaaacaaaacatcagagaaactctccaggacgttgggctggcatacatttattgagtaatatcccaaagcacaggcaaccaaagcaaaaaaaacggacaaatgggatcacatcaagttaacaagcttttgcacagcaaaggaaacaatctacaaagtgaagacacaatccacagaatgtgagaaaatctttgcaaactatccatctaaaaagaaactaataaccgaaatttataaggagctcaaacaactcaataagaaaacatacaataatctgattaaaaatgggtgaaagatatgaatagacatttctcagaagaagacatacaaatggcaaacaggcatatgaaaatgtgcttaacattatttatcatcagagaaatgcaaatcaaaactacaatgagttatctcaccccagtaaaaatggcttttattcaaaagacaggcaatgacaaatgctggtgaggatgtggagaaaagagaactctcatacaccgttggtgggagtgtgaattactacagccactatggagaacagaatgggggctcctcaaaaagctaaaaatagagctaccatatgatccagcgatcctactgctaggtatatacctaaaataaaggaaatcaatatattgaggagacatctgcattcccatgtttttggcaacactattcacaatagccaagatttgaaagcaatctaagtatccatcaacagctcaatgaataatacaaatgtggtacatatacacaatggaatactattcagccataagaaagaatgaggttctgtcgtttgcaacaacatggatggaactggaggacattttgttaagtgaaataagccaggcaaggaaagacaaacttctcatgttgtcatctattttggggagctcaaaattaaaacaatctgactcatggagacagagagtagaatgatggttagcagtgactgggaagcgtagtgggagggtgaagatgggaaatggggatggttaatctaaaaatatagttagatatgaagaatgatatctagtatttgatagcataacagagtgactacagtcagcaataatttgttttatattgtagaataactgagggagtacaattggaatgtttgtaaaacaagaaatgatgaatgctagaggtgatgaaaacctcatttattctgatacgattattacacagtatatgactgtatcaaaatatgtcatgtactccataaatgtatcctactatgtatccataaaaattaaaaatgaaaaaagatgactcttgaactatacttatactgtgcacaaaaattaatttgtatggagtctgaacataaacataaaagctaaacctataaagctttaagaagaaaacatcgaaaaatacctttgtgatcctagagtagtgaaatatttcctggataagacttggaaagtgataaatgtaaaagtagataaataagcttgatcaaaatgcaaacttctgctcatcaaaagatggcattaacaaaatagacaaaacacagcctacgagacaatacagacaatataaatttctaacaaagtacttgtatccagaatatatgcagaaatgctacaactcaataattttaaaagtccagttaaaaacagatgaaagactagaatagacacttgacataggaagatatacaaatagctgatgagcacaggaaaagatgctcagcatcgccagtcatcagggacatgcaaatgaaaagcgtaatgagatactaccacatacctactacaatcactctgcaaaagaatattttggaagtttccttttttttttttttttttttttgagatgatttcactctgttgcttaggctggagtgcagtggcaagatcatagctcactgcaaccttgaattcctgggctcaagagatccttccaccacagcatcccaagtagctgaggccgcaggtgtgtgccaccacacttggttaatttttaaattttttttagagtcggggtcttgctatgttgtccaggctggtctcaaactcaagggtcaagtgatcctcctgccttggccccccaaagtggtggggttatgggaataagccatgaatttcttgagaagttaaatgtgtatctgtcttaggacccattactctccttaatgcttacccaggagacatgaaaacacatccacatgcaggcttgtctatgagtgttcaaagaggctttatttggaatagccccaaagtggaaacagtccaaatttcatcgatatgtgaaagtataaaaaattatacctattactctagaataaaaaagaatagactattgatacatgtgacatgcatctcaaaatcattatcatgaatgaaagaaaagaggccaagaagattcatactgcatgattttcttcattgtaggagtctagaaattgcaagataatctacagtgatggtaaacagatcagtatttgcctggggacagaatccgtaactccatggattccatgggtgtcagagttgtgctctgacttatctgacatatatcactatttgatggacaaatgatcatataaagtgaaaaatcaacctctaaactaagagtttgggatctaactccagaataacaccagtaacctctgtgtgtctcattggaagaacatatgatgcttcgaggatggttatgtcagagagcaaatgagatggtgtgtgaaaaataatagtaattataagatctgatataaatttaatttattcttattgtttgttattaatagctagagataagcctgaaattataatttcatagctcatcagtgagggcaatgaaggatttgcatcaaaataagcttcggagtcagtctctctctctcacatgcatacacacatacacacatgctcgtatgcatgcacacacacaaacatacaccactcaggtttcatagacattatttctggagataaagagtatggctctgaattttgtttctaatgctgttggttgtttgcatgctaattctagactaggaatcaaatcctaaaacgtcagttatattgtgtcccactgtgacgaccaagaatggggctctcacctctgcctacctggctcttcacgtgaagtcgccttcctcatttgtccactctcaatttacacctattgcctcagtatggttattaattgtgctttcttacattttgagtgttatgagctagacagtaagttaacattgaattaatatttctggtttggatctacaaggtgggaattattcccactttaaagatgaagcaaatcacttgtctactacgctacaacattgtcttagagaagggagaccaagactctgggtaatacaagactgaatacttactgcgtgtccactctatgcccagtactttcgaaacgctttccatatattagctcatttaattttccaaaaatgctaggaggataccaagacattagtgttattacagattacgaaacaggcatgagaggctaagtaacttgcccaaggccatggaacaagtgagagatggaactggatttgaactctggtaccccagctccagagctggtgggtaataattacttgctatgaaaagtattacaaggctttcttttttgtgttgcttctacctggtacaagaatcttgatgagccaagagttactggaacttcagtaagctcattacttgaacacatttatttttaaccattttcccccccacatagatttggcattattaacagagccaaagccaagtgacgttggcccttgataaagacacagcttatcagagcctgtgcccccttccccctaggcatcttctatcactgttgcaggtgcaggccccctccacacccactctggaaagctgagggttgtggctggttctccttttctaggacattccctgaggccacttgtggcagccgccaatgtgcttgctcttcctattttatccttccaggcatgtggcagctttacctaatgaccgaactcccgaatgttcccattctgtcctgcctctcttttccccttactccaagaatgacccattatgggttattagcactgccctgtttttaactgggttgcaattcatgcagcctcctaactgcaaaatcacttccctacagccttccttcagacaaggtggaactggccccagaagctgggtgtttacaccaaagatttttttttttttttcgaaagctgccttctgttttgctcttcccttactgtataacagatagcagggtgcaaaaagccctttatcctgttaatagtggccttaggtaaggaaaaaaaaagagcatgattcaagttttctgtggcctctggctcagttgaaatggaatgtaagtgcaatgccagagcctggtaaaaatagaaactccagtgtccagactcctctccagatggtgtgggaatccagatagcaactcatcactaaggagggccaccattaattagtgggaagatgtcatgcctcacactggggagtaaatgaaatggcctatagcttagaatggaacctctctaatcgccagagagtccgaggtttctccctaagtctctttactctggcttaaccgagagttcggtcattacataaagctgccacatgcctggaaggaggaaataggaagagcacgtgcagtggctgctgctagaagtggcctcatggaacatcctagaaaaggagaaccagccacaccctcagcttcccagagtgggtggggagggggctggcatctgtgataatgagagaagatgcctagagggagctggacccaaactctgataagctgggtctttaccaagggccaaagtggcttggctttggctctgttaataatgtcaaacttatgtcgggggtaaagtgctataaaaataaacatgttcactgaacgagcttactaaaattccagtaactcttggcttatcaagtttcttgtatcaagtagaaacgacacaaaaagaagccttgtaatacttttcacagcaagtaactattacccttcataagaatcacaaatctaacccctttccattaagcatagcctcctaaaaggaattagctttgggccctgggcaagccactgagctctgctagtctccccttctttatcaatgtcatgagggtgatcatactgattttcagattttcacagggctgcttcttttgataattaaataataagaaggtacaagaatcaagaagggtgacaagcacatgggtggctaaaaatattaactgaagaaatcaaagcaatacaaatgtttggcaccactaagttagaaagagtgtatgagaactggagggaacccctctgctggtcaatttttattatttggagtaaatgtcatctctcagagaagctgttctcaaagatcatgttgcattgttaattttggtatctgtctctcttaatagacagtgaaccttcaaagtggggaggaccatagcatgttcaggtctcattatagcatgtagtgcataaaggtgcttggatgtttattgaataaaagaatgagtgaagatttggaataatggaaaacattgggaagggtgtttcttttggtgggaatgtagcatgatgcaaactaggaagttacttagaatgtccaggaaaagacaggagagggcagcgtgggtggaaaacaggaattgaggagtactgagcaagagacacaccaaagaggccaggacccatccaccttatctcctcacctataaattctgctcccctcctcctttgcaaggtccaagcctcacaatgtggctccctctctacaccatcacctcctgctcctctttggaaaaggaaccacagttcccaagctctttatactagacacagggcaatgcattctgcacttattttttctaagttcatactttgaataagtaatacatttacgtggctcaaaaatgagaacactgtaacaaattataccctaaggtgttatacccttgactttatttcccctatcccccttcaatccctagacataatccttttaattagtttcttttttattcttccagtgttttatgcaaatataagaagtatgtctatatattatttacttatgtttcctacacaaaagattgcatactacatatacttctacatattgctttttccacttaatacaacctggtcctcttttccctatcaatgtgtaaagatcttcatccttttttatagctgtgtagtattccattgtatgtatttagcatagtttattcaactaatcttctagtgctggatttttttcattatatacactgtggaaatgaataactaaaattttgaacagtttttttaacttagccttttacctgattgttgatgccttttcttctttggtgatcttggcaattcttaggactctatagatcacttctatgctgatgacaaagccccattgcggtgtgcatcccctttcctgcttctagctgccttcctgatctattacaatcaacagcaactctaaacttgacctcattttctcctcctttgcttaggaggttttcctagtgaaaagtatacactgagatgtcacattctctctcctactcactaagataagaaacttcagttgcctgtgatttcttctctgccttgaactctacatccattgggtgtaacaaacacattgttttcttgcataacattttggacatatgtcctttctttttattcttattgtcataaataactgatttttccacttttctcttacatgtcttctgcaataatctagacagctttggtaggaaacatctcacaacttgggtgggatcatttttctgccattagaggtatcccaatgcctaatgaagaaagtgtacattgctgtttgtaatgagaaacttgctttctctttattgatgagtgagctctttaggagtagacacctgccttatttactacaatacccttaccacctgccatgatgctgggcataaggtatgtgttcagtaaaaaattgttgaatttatctctgcaatacaatttcaacgggcatttccaatcttatctcccattattcccctaaacaaactttactgccaaagctaatttgaactattgtccagatatactatttaactttcatgacttggattatgccattctctctgcctagaatattcttcctctgtctctatgtgttactctgttcaggtactgaaaagccaacagtttccaaggcccagcacctctgagaagttctatctgattaccctgaaaccaccgaggcccaaaagaaagcaacttcctcagtagaggaaatggaaccagaaccctgatttctcagctctcatgagcctagaaagagtagagactctaagatccagaactgcacattctatttcccagtgagccatgacatcctgccttggaggccagaatgatacttgtcttacaactttattggataatagggaggatcccatggaatgatggaattagtaatcatttataaaagcacaaaatcttataaactgtagtgaagtatgtagtgcatttctattcaattaaataaacatgtattaaactcctacctctactatacactgagcaatgtgctacaaatggaatggtttcttcccacaaagcgctgagtaagagaaagctgtggccttattgaatctattgatttagcctcaataaatgcagaaggatgtcatctactcacacgaagataaaagggttacaatcatggacatggcttacctctctaaatagctcgctatataattttggcaaagttccttgaacaatttggtccttagacttcctagattgttcatggaactttcttcttagattattataccctgttctgtgtctcagtttgcaatttttatcccagcagaggaactctagttctaagagggagatctgcccttgaaaaccggctgcccttattacttcctgcctttcttttaactgagctccactggctcagacacataatttttgttaaccatgaatgctttaataaactcagaggtcgaatcaataaagccaagatttttgaccaattgtggtcaacacaagtaccaaagtaaatttttacaaaagggtcaccattcaatttctagtaatttagggcaaattccacgttgggttaatttcatgctgcatttctgaattcccaaagcagtttctacagaatgtcatcatgactatgggttttttcccttgatccgtcctaagacttggtgacaggcaacaagcctgaaacagccattctatttcactggggagagagattgcatgtgtacctggaatgaaaccatctgctagaatcttgcagcagtgtgataatggagaataaaatggagaattgttcaagggtcttagttgaaggtaacagtatttacgggatgacctaaaacaattcaaataagaaagccagctttaagtaacaatatcccactgctatgtcacactagtgaggcagctctggcatggtccagcttaaaatatggctagtgatttgattgtaaaatattagctagctcactggagagctggcacaggactttagaggagacctggactcattttttcaggtctcactcttcaacctcagcatgcccactcccatagaatcatatatgaccaacacatctttgttccttggatggcacgtttgcagttattcttaatgagcatgcttcctactcaactgacccgaaatagtttgtaagtaaaataaagagaattgccctaatttcaactatgattaatcaattagttgaaaaatcaattacctgacaaaaaaaaatccaagattcacttcgcatgactttttagtctttcatcatttcccacatttgtgctcctgtgttcaaccagctttggaagtaaattaatagaaaaagatgaaggaactgctttgaatccatacaagacatggtttatcaaacagttcactagcaaacatagatgaaccttgggtgcatttctttatcatcatttttgtgtgaggccctagggtgagaaatagaaatgaaggctggattctgtccatttgggtctcactgtctagctttctttcttttcttttttttttttgttgagacggagtctcgctctgtcgcacaggctggagtgcagtggcgcgatctcggctcgctgcaagctctgccttccaggctcacgccattctcctgcctcagcctcctgagtagctgggactacaggcgcctgccaccaccctcggagaattttttgtatttttagtggagacggggtttcaccgtgttagccaggatggtctcggtctcctgacctcgtgatccacccacctcggcctcccaaagtgctgggattacaggcgtgagccaccgcgtctggccctcactgtctagctttctaaagacaaactggtatttacaccaatctctccttgtcactgccactaaactccagtccactagagcccactcagaaaacctttctcaactgatgggagcataaagtttgagattttgcgatcactcttaaatttcttctatgttttagatggatataacttaagatttgtaaagttccaaatcttcagatatagaacatttccagcacctcagaaggctccctcatgctccctccctataaaggtaacaactattccaatctctgacactacagcttagttcgatctgcttttgaacttgacgtaaatgtcgtcacgtggaacgtactatttgtgcctgactttgtttactcagcattacctctgcgtgattcattcacattgttatatgcatcagtgctttgttcctttttatttatagtaggaatataacacaatttatttacctattccacaggtgatgggcactggaataggtaaatattacaaataaagcagccaaaaacattcttacaaatatctttgggctgatatgtcttttctaaagaaatcaaaatttctaatttaataaattatatgttttctagcttggaagacgaagacaatgagatctaatgaaatgagaggctgagaaaactggacctgattagatgcatccagacgtaatctgtgcaaaaaccatgttttttccttcttcgacattctcatgcctgcttcttcctcctcctctgctcccactcttagcagtggcaactcctggtgacctatttttcttctgaggcttttctcatactatctccatattctgtcaactcataaccactcagaaaatttaatatcgaataactgatactcaggttaaaataatggttacactactctcctgaataatcaaataactaataggtttaaataataatgacactactttcttaaggatatatgcttatttacaggaaacagggatctatctctgtggagaaattttagaagtcagtaaagttcaggagatagtttttgagtgggtaaaactgattttcagtaccagaaaatcataaatgagcatctttcttgtgaagccagttcttaatacatccaaaaaagggagttgcctttttatttttatttatttatttatttatttatttattttctttattattattatttttttgagatggggtctcactctgtcacccaggctggagtgcagtggcgcggtctcggctcactgcaagctccgcctcccgggttcacgccattctcctgcctcagcctcccgagtagctgggattacaggcgcccgccaccacgccaggctaatttttctgtatttttagtagagactggagtttcaccgtgttagccaggatggtctcgatctcctgaccttgtgatccgcccaccttggcctcccaaagtgctgggattacaggcttgagctaccacgcccggcctgcctttttataatacatttaattttttaaaaatgctgataaagacctctagtttgatatataattctcagagttgcgctatcgtctaactacaatttttcactcatacccttcctgtcaattgaaagctaagggacaggtaataaaagactacacttgcattaatagtaaaacatactagggaaaagtttttcagttacagtttcagaaagttgttcagttgctatgagagtggaaactaaatatttgcttccttctattacaaacacagcagaccaacctaacctaagtcaccaaaggagcagttaaaatcattttcagtgacatcgtggggctaggctttttaaagcaggattgagaagaaggcaaaacaactataaggtatccttttgttttttctttcttaacccactcatctaactttctgcctcattgagcttccttcttacaaataaatgaattaattaagaccctacttgcaagaaaacctgtggttaaaagggatcttaattcctcttgcatctatccatccatccatccatccatccatccatccatccatccatccacctattaatccagtcaaccatccctcaggtgcttggcctggatcccaggctggtgggttacactgtggacatccatcctatgcttgagtgtttccagtgatatggaattcatacaagccaagcagccagctcagttctgacaaggtaacaaagttgcctaattagaaagtaatcaatagctagttttgataaggtggcattttttctcattattttatttcccatttttttaagcttttttttccaaacactgggaaaataggatattaaaaacaaaaagcaatttcatatgtaaatgtctttttagactaggctcaaaaacctggacacagtgaaggatgatgttgacagctaacatttttctatctgacttggagcaggtgaaagatttctctacaagtgacatggacctgccaagccaaaccagtgatcctcaggtcaggccaagctttgtaacttggggcccacagatgtggtttgtttagctagcacaatatttttaaaataatgagttagttgccaagttttaaaattagactgtttcacataaaatttgagtctggctgatcctaacaaaaagagggtgcttatttatttttataaagtttttttcttagctttaaaggagtggttttagtgattactatctcctatggtgaaaaaaaaaaacatacttcctagaattaaatgattcctttctaaaatttttcatttatttatgtttctagagacagggtcttgctctgtcgcccaggctggagtgcagtgatatgatcatagattactccagcttgaaactcctgggtttaagcaatcttcccacctcagcctcctgagtagtagggactgcagaatagctgagacttcaggtgtgagccaccacacctgcctaattttaaaaagtatttgtagagatggggtcttgctatgttgcccaggctggtcttaaactcctggcctcaaggaatcctatcaccttggcctcccaaaggccaaggattacagctatgtgccactgtgcctggccaagtgattcctttcatttagctttaattttacttctgttaaataatttaaatttaacacttctttaaaataaagaaatatatatcatctgttttataattttctttctctccatctatttactcatccatctacccttccatctagagagatgtctagatttgtgttggccaaatgataatggtggttactttaggatggtggaattttagatgacctttaactttctattttgtattttgctgtgctgaatttttagtactcaacatatttcatttttatataacattagtccttgtcatttaagaagtcctttaaaattaaaatatgtctctcttcttttatctcttgaactgaacctttaatggatgtgattaagtgagatctaaattaatggtgaatgccctttttcaggtaacaagaaaaatgtgaaaatttgagcttccttattagacaggcttctcccctgatatcaatccttatgtatttaactcactgtagtaatttagaaaaacatgttttatttcttttattggtcaatataatttagacgcatgggccaaagtatcaaaaatttccactaccaaatcctcaccaagacttactgggttaaatcttgtggtaaactataataggataacagtcttaaatagatacttgaaatcacatgcagatttccttttctggaaatagggcattctagaatactgaaaactattttgccagagaacacctagacagagtggaaaaagttgataagctttcttttacatgcatggttaggtttgcaagatagtaaaatttttccaagggagcaaaaaattatccaaagcactaaaacaagaggtagcaaaaacctaagtattaatgtaacactgatttcaagctaccttatgggatttgttggtcttgacaatcaagtgatgtgggttgcataaaccacatcaggacagaagatgaggccttgggcttacataaaattggaaggaaaataaacagagatccctacatgcaagcttgaaccctcacagagctaggcctttagtgaaaggtagatgactaggaacctgatcagtctcagcctggatactgtttgtgggagagaaaggtctctgttgagtactgaacaagaataaaaataaagcataccaaaacttgtagaatgcagccaaagcaataattggaaatgtgcagcctcaaatatttctatcagagaagaagaaggctgaaaattaatgagcaaagtagctgtctgtgttccctataaaacaaagggtaaggcagtgagtgattaagtgctaatgcttctctggagaggttccagggcagaaggaatgagagaaaagggaaatgagacagggcaggatgagaagcaagggagggggcgtgtccaggtgctgctggttgctttatcatgagccttgaaaagtcgctggttccatggcagctgtacccatttggtcactctttgggatctccagaaaggcaagacacagaaacagtgcctcacagcagcatcccgaggagtcgtccctcttagtgtaggcctgagggcgtggggaggagcagccctacaggatagatgtaaaatcccacctggatctgtctttcctatatttcctttggaacaaaagccttaaattggtgtgggaaggacacaaaccctgtcaccttcaaggaattggagaaaatccactgaaactggggaagggcatgagaaaaaccgtattccatgaaggtgggataaacttgctgggttcagacctattgattgggatcaaagcaaatcactgagggactcctctcctgagacccaaggatgcagtgcctgccaaggacagagacttaaccagagcatcagagcccacccatgtgctgcccctggaaccagtgtagcatacattgagtaacaagtaacagtggtctatggctgggagaagggcaaaaacaacaagagaggtgctcatggtgtatgtgtgtgtgtgtgtgtgtgtgtgtgtgtgtgtgtgcatccacattgtgtgcacacgctcatgtgcacacgcctaacacactgaggcagcctgcatggcacccagaccagagcacctgtgcggtcacacaaacactcgagtggacactggctcactcacacctccatgtggcacctcagcgcccaccagctgctcagtaccttgtccacacacacttcttgtagcacaatgggaagacctaaagcggaatatggagaagaccctatgaaagcccctggcatgccagcccccatcctacaggagtttgaacctccctctcactctttgcaacaaactaactcaaacatgtcatagactcaaatgtaaaactccaaactgtaaaacatctagaagaaaatgtagtagaaaaatctttgtcatctggagttagtcaaggattctggggttaaagatttcttaactacaactccaaaagcatgacccataaaagaaagaagataaattgggcttcatcaaaatgaaaaactgttatttaagaagtctgtgctgagagaatgaaaggcaagccatatactaggataaaaatatttacaaaccatatatctgataaatgacttgtattcagaatatacaaaaccatcaaacgaagtaataagaaaacagacaattcaataaaaatagaattgaaataaatattgggacacatacttcaccaaaaagataagcaaatgtcaaataagcaaatgaaaagatgctcaacatcattagtctttaggaaaatgaaaactaaagcaacaatgagataccattttacatgtattaggatggctaaaaccaaaacgaaaacaagaacatcctgacaattttgtgtactggattgttcatatattgcttaaaagaatgcaaaatgatacaaccactttggaaaacagcttggtgatttcttataaagttaaacatacgagccgggcactgtggcccatacctgtaatcccagcactttgggaggacaaggcaggtggatcctttgagttcaggagtttgagaccaggctgggaaacatgaaaaatgctgcctctacaaaaaatacaaaaattagctgggcatggtggcagatgcctgtagacccaaccactagggaggctgacattggaggattgattgagcctgggaggttgaggctgcagtgagctgtgattttgtctctgtactccagcctgggtgacagagcgagaccttatctcaggtaaacaaaaacaaaaacaaaataggcttatcctaccacccagaaattcatttgctgatgttaacccaagttaaataaaaacttgttcatttaaaatctgtatgtgaatgtttacagtggctttagttacaagagccaaaatctggaatcaacacagacatacatccttcagctggggattgatgaatacactgtggtgtatccacatagtggaatgttactcagcaacaggaaggaacatcccaacatatggatgaatctcaaacacattacgctgagtaaaagatgcctgactccaaaggctacaaactgtatgactccatttatatgacatttttacaaagacaacactatagagaaagaaaactcagtggttgccaaggatgggggtggacagacggtttgactataaacagacatgagaaaatttctgtgggtaatagaacttttctgtcttttttatggtcatggcatgtgactgcagaaatttgactcacagaactggacactacaaagataaattttagtctatataaatgaaatcttaatattaaaaatgaaataatattaagtcaaaaagaattccatggtatgtcactatccaaagacaaccttattaacatttttttgtttgtaaaattttctgaaatcatttttaaaaaactgcacttgctgcttcctacacgtgaacaatagacccagaaaactttacagatgagttttaccaaacattcaaggaattgatggcttaactatctcaaagtataatacataggaaaaggggcaaaattttcctagttcgttttatatgactataaataaaaagaaccaaacagaaattctggagctgaataatacattaaaaaagaaccaaagagagattctggagctggataatacattaatacctctggaaatgaggtacagagcgtcaacagcagacttgatcaaggagaagaaagaatctgtgaataaaaaggccagtaatttgaagttatccagagaagaaaaagtaaaaaaattaaaataaaaaaagtgaagaaagactccaggatttatgaaatgttatcaggtaaaataatacatgcataatgaagaatttaagaggaaaagagagagagagagaaagcggcagaaagcttgtttcaagaaagaatggttgaaaactttccaaaacttagaaaggatgtggacatccagacttttgatgttcagacttccaccaaaagatcaactcaaagatgattacacagagacacattataatcaaattattaaaagtcaaagacaaagaggattccaaaagcagcaagagaaaagcaggaaaattccatgaggctatcagtggatttcacaggagaaaccttgctggccaggaggggagtgatatattaaaaatgctgaaagaaaaagactgccaacaaagctgtcctccagaattgaaggagagagaaagactttcccagagaaacaaaagctgtgggaattcttcaccatgaaactgccttataagaaatgataaagggagttattcaagttgaaataaagggatactaataagtaatttaaaatcatatgaaaatataaaactcacttttactctagtataaaagttaaaatacaaaagtattaaaatatagctacaataattaataaataaacaatacaaaaagatgtaaattgtgatatcaataaatcaaacgtgtgttgggggagagaaattagagggtaagtttttgtatgcaattgaatttaaattgctattagcttaaaatagattgttacaactataagatgtttgatgtaagcttcatggtaatcacaaagcaaaaacctttagtagatacacagaagataaagaaagaaatcaaagcatactactacaaaatatcataaagaaacattgtaatataggaaaaaaggaactacacaacagtcataaaaattaataaattggcaatagtaagtagctatctatcaataattactttaaatataaatggattaaattcttcaataaaaagacacagagcacctgaatgggtttaaaaaacaagatccaaaaacatgctgcctagaaaagactaactttagctttaaagacacatctgaaagggaagtgatggaaaaaagatattgcatgtaagtggtaaccaaaagagagcaggggtagctatacttacaccagacaaaatggacttgaagtaaaaatctgtcaccacagaaaaaaaggtcgttatataatgataaaggggtcaattaaccatgaagatataactgtaagtgcacccaacactacagcacccaaatatatgaagcaaatattaccaaaactgaaaagagaaatagagagcaatataataatagtagtgaacttcagtaccccactgtcaagaatggatagatcatacagatgaaaaatcaataaagaaataccagacttgaattatactacataccaaatgctaacagacgtacagaatatttcatccaacagcagcataatatatgtttttctcaattgtaggtggaacattctccaggatagatcatatactggaccacagacaagtcttaacacatttaagaaaattgaaatcatatcaagtcattttttgaccacaattattgtcaattattacctcaatagtgctggaaaaaaagtgtacatctaaatctcagccccagggatactttcttgactaaacatcattgatcaccacaggtttactttgtctctctttggctggatagtacagccattctcttctcagtgtagacttttcaccaccttccccatgacatagactgagcattttctggctctttgcaccttacactttctcaccttacaaatccatgtatttgtgggcacatgcaccatatgcccacatgcctatgccaatatgcgagcattgttagacagaatcggcttgatgacactgagattctgggaaaatgcagcttctataggtaatgagcatatatatctagtcacatttaaaaaaatagaatttattttgagttaattgtagattcatatatggttgtaagaaataatacagacagatttagtgtaacctttaccatatgcattaggccattttgttgttgttgttgttgttgttgagacagagtctcactctgtcgcccaggctggagagcagtggtgccatcttagctcactgcaacttccacctcctgggttcaagcgattctcctgcctcagcctcctagagtagctaggattacaggcaggtgccaccacacctggctaatttttgtatttttagtagagatggggttttgccatgttagccaggtggtctcaaactcctgacctcaggtgatccacccaccttggcctcgcaaagtgctgggattacaggcatgagccaccacgcctggccacattaggccattttagtgttgctatgaagaaatacccgaggctggatgagttataaagaaagaggtttaattggctcatgttgctgcaggctgtacaaacatggctctagcatttgcttctggtgagggcctcaggaagcatacagtcatggtggaaggctaagggagagcaggaaatatcacatggtgagagtgggagcaagacagagcaagggagtggggaggcctcagacttttaaacaagcagacctcgagtgaactgagaactcacttttcaccacggagatggtgttaagccattcatgaggaagccaactccctgatccaatcacctcccaccaggccccacctccaacattgggaatcacatttcaacacgagatttggagggggcaaacattcaaaccacattaccaggtttcatccaatggcaacatcttgcaaaactacggtacaatatcacaaccaggatattgacaacgatacagtcaagatacagaatagttccatcctggcaaggagctctcaaatagtccttttatagccatacccacttcccttctgccccaccccgatcttcactcctggaaatcactaatctgttctctatttctataattttgtcatttcaagaatgttatgtaaatagagtcatacagtatgcaatcattttgggattggctttttccacttagcattattctctggtacttcatctagagaatgttgcacatatcaatagcttgctattttttattgctaagtaggggtgtattaccatttgcttaacccttcattcactgatgaatatctggattgtttccagtttggggctattacaaataaagctgctgtaaaaactcctgtacaagttttttgtgtgaccataaattttcatctctctagaatatgtggccagaagaacaactactgggttgaatggtaattgcatgttcatatttttaagaatttgtgaaagtctttccaaagtatggtatcgtggttgagagagaaaactgtggagccaaaccaagagatatccaccacttttgagttgtatgtgtcttgatatgagagcaaatctctccaagactcagcttctttgtctataaagctatgcctacttcataaaatgttttgttaaattgtctgagggctaaaagggattatacaaacaagttcttagcatgcaactactcagaacttgaaatgtggccaggatcattgaggaagtgaagcttttcatttactcaattttaagtcacttaaattaaaatagccatacatggctagtggctactatatcagacagcacagatttacattcttacaaaatgaagattacaataatcctcacaaggttgatgcagaatgaagaaaaatgcaaaagaaaactgcatgaaagacattgtagtatacaacctaaggtgctatttatagacaataacttactcaaggatggtttagatacaggctgtattagtctgttctcacattgctacaaaggaatgcctgagactgggtaatttataaagaaaagaagtttaactggctcatggttctgcaggccatgcaggaagcatggtgacttccgcttctggggagatctcaggaaacttacaatcgtggtggaaggtgaaggggaaggaggcacatagctggagcagaagcaagaaagtggtgggaggaggtgccacacacttttaataaacaaatctcatgacagctcactatcatgatgacagcaccaagggaagatggtgtcaaactatgagaaaccaccctttgagtcagtcacctcccaccaggccccacttccagcattagggattacaatttgacatgagatttgggtggggacacagatccaaaccatatcacaggccaagaaagtttttctctcctttccaactgtgaactgtaattttttgttataggcattaacagaagaacaaacaccagcaagaaatgaacaaaaaatgggggagggcagtgtcatgaagcaaaatatgtggctagcctttctgcaaagtgtgctcttgtctgtgacacatgcttctttggccacatggtatagtgtctgccttccacactgtcacgtgctgggggctgggcatgggcggtgacttccatctgcttcctcatggagcacagcctcacagaattcatcatcaagataggtcatgaatgggaatgcacaccagtgtaatatctttgtccctggtgagccgtatctctgataccttctaaaatgttagctagagaaagcagaggtgtttcattgacaggtaattattgttctctcataaaaactgaattctatgaagaacaaaacctttcctccatcttggaagttgggacaaatgcactggttcggggagcgctgggctaaggatcaggctgcttgggctatcaacatatttgtgtcaccacctatctaagtggcaccaggaagcccaccttcctttttcctataagacagaggatcaggactagttggcctaggacccctaccaggaccatcatttcatcactcatacttgacacctcatattcttgcaacttcaagggcacaaccactctctgatgtgtgttataattatagttgtcaaggtgaagaacccgaggtaccataagactatggcttggtcaaaaccccacaatatagtaagacagcggcagaattggaaatgaaatcttcatactccaagcctttctttgggtctttgttccacgctatgttactctgggctcatttagaagaaagtattgccctgggctggaaaatggagtgcccaatgaatagagctgcttctttctcctccccctgcctcttcttgctcagcccccacacctgctgtactggccactgtctggatgtagtaggagagagaagaaaagcagaacaaaataggtagggggcaaggaaagagaaaggtattagaaaggtaatagaaaggatatataatatttttccatctgttcagaaagaaaggcacttagaacttcagaagagccagcatttttacagaatcacgaacagtttaagcaagcaaggacagagaagtgaagtgactcatcctgggtaacaggggtctatctagtaagcaaaaactaataaaggatggcaaagcataggaattaaggccaactagagtctccgtgtcagccctgttgcatgcccgccgggaagccacggtcaaggcagcctccttcaaacttcgttttttgcatctctgaaaggaggccatgataccaacattgtaaggttattgtgaggatcgaacaaggtaatgcctgtcacacagctgaccaaaatttaagagcttaatagaagagaaaattgatgagtttgggctagaacccagatattcctgttcaatcgagtgctcttcccagtagaacacgctgcccctcccccttcctccctttttgctcaatgccagcatgctcccttaagctctctaattagctaaataaagagtgcagacagggcctatgttaaaaaatgctttctgagccaagtgaaatccctagggaagtgaaaagaaaagaaaaaacacacacatggccaattaccatagcatcatttcatttcctcagagtgactaatacccagagacagtcacttaaacactaattgcaggagaacaggtagaaatcatgttaaatgagcccatctttattcctggaagaaaagacagcaagactctccaatgcatgagtatgtctgcctcttaatcatctgcagaaagagaaggcagcttccttctctgattgaacattggattttgatggcatcgtagttcttcttgaactagccggcagatctgcagtgtggaattgagttaccagtggagcaacatgccagcttccttctgacagcgtttggttgttcagaattcaagcatggcataaaacaatgcctgcatgctccagagagacccccagcccccacatgtcccaccctgagcttgctaggccttccagggcctcggtccccacatctgtgttgggagagaggagacagttccttctttagggaatgggggtcatagagatatcttcactctctagcttgttttcttctttctgattgtagctcagctccttttcttttcttctctcttcttcctgcctttaaccattcttccatgaaacactcaagtgggagagtttggttgtttgacaaaaaatggggagggtgggtagggaggaagatggagtttctttgttttctaattccgccctacttcgtttcctataaggggaccaggaacacttttcactggtcatcgtggggcttctcatcccctaaaggccatattaccccaacttctagttgtcagctatccttgtcaaaatttcctaattttgatacttatatcccacttattcactaatcccagatcaagcttcacttcctccaaaaagtctttttcaactatgtcagccttcacagagcaactgtcattctttaggaaaaatcaaaatttagcttgtaatgatatatgaattgcacatgcacgctaatttatactctccctcctgatttaacaatccttaaggaacagtctcccttgtatcctgcgggcattctggttcgatactaggcacagtgttgattgcctgtttgatacctgcttaaaacagaaaatcgacttccaagttctgcgcactggtgtttgcatgaggacatgagccccattccttgaattcctacaatgtcccaagtgctgagctgggcactggccatgccaaaaacacataaacacattctgtccagagagtgcttacctcttcttcctgagaagatggccagctcacttacacaatgagttcattttcgtcatggagatcatgaacagagggtgcattccagctgagctagtacttcctgcccctcaaagctcagctcaaagtgagtttccttctgtggccttcctcaggccatggaaccttaagtttcttcatttttttccctaagacaatgaaaagaagaatgctacagtaattaatgaaagtctcatgagtgatctcttgcatctatttccagtggatagttgggtgtttctgactggcaagcaattctcctgcagaccaaattcagggacccaggctccttccacttgtggctctgccacctgcaaaggccttggagtgacctgcatccagagggcaatggcagggtcacattatgacttttatggctccagtgactcttgccttcatgggctccttcttccatgcaaaaaattaaaaattatattttataactctattggtataaagatgactacattgtatataaatatatttttttggccaaaaagtctattttgttatcttgattttaaagaaatagaaacatttccatgaggccttaaaactcttgtggacctgtgctcatctttgtctgtgcttacctcccagtctgacccctgcggtgctcatcgaccctatgcccttggatccagcatgtgccaccttgctttgccttcttggcatgttcctgttagcctccccagacagacagcaagatcttgggtcttttgctagctccctagcacattacaccaagccttgcctagggcgagggtctcccagtctgattcctgaatttgaccagtaggagagctatctgccaaccagaaacaccgagttcccaactggaaatagattcaagagataatctcataagacctcagtcaattactatagcattcttcatttcactatcttaggaaaaatgaaaaaacttacagttacacagtctgagggaggacacagctatgtatgattgtgcccgttctgcaaatcactaaccctcagtttcctcatctgtaaaatggagggcaagaactgaatctccctcatggtactgcgtgaagaagaaaatagatgattcatgcaatgtgcttaaaatagtatctggcatgttgtaagcactaaataaaggttaacctttttattattatgacaatacaacaatgattcatatttatgaaatacttgcgtttttctaaaaactgccacaagatgataacatagctataatcataatgtctcattgcagccaaaacttgtttatgggaaatgttgaggttgaatggaaatgttaaagacagatgtggatttaaatctcagctttgccacttgccagcttagtgacatgtgatacttacttaatttctctgagtgtcttagtctgtttgggctgctataacaagatgtcctaaactagctggcatataaaaaacagaaacatatttctgatagttctagatgccaggaagtccaagatccaggtaccagcagttgcggtgtctggtgaggtccactttctggttcatagaaggctccttctatccgtgtcctcacaaggtggaagggacaagacagcgctctggggtttttctttcttttctttcttttttttttcttttttagcaacaagaatgctcaatttatttattttttcttagcaacaggaatgcccagtcttgggctttttccataaagacacgaatcccaaacatcagcgctctgcccttgtgacctactcacttcccaaaggtctcacttcctagtactattacattggtgattaggtttcaacatacaaatttggggaggggtggacacaaacattcagatcatagcactgagactctgtcttcttacttgtttttattttactttattttattattatttttttgagacagggtctcactctttcacccaggctggggtgcagtggcgtgatcatggctcactgccccctcaactttctgggctccagcaaccctcccacctcaacctcctgagtagctgggaccacaggcatgtgccaccatgcctggataatttttatatttttggtagagacagggttttaccatgctgcccaggctggtctcaaactcctgagctcaagcgatctacctacctgggcctcccagggtgctaagattacaggtatgagccactgcacctggcctttcttatttgtaaaatcagataataataccacttacttcacaagtattaagaaactgttcttggagtgcttgacaccagtctgccttttcttttttttcttttgtcgagaataaagatgactgtctaaacaaatacctcctactcatccatggttacgaaagcttcaagtcctcattagagacaaactttggtgttaggctcaagaatgctagctcccttcccttttccctatccctgttaaaataaaaaacactacacacctagaaggataatacatgagtccttcctcagtcattaacaccttaacctaaatgtgcttcttgtctccagagagcaagctctatcagctggggaaagaagggagggtttaagaatgtagggcagaggcacaggtctgtgatgccgaggactgattttgtttctgttaattttatttttctgtgatactggcattcgcataatatgacaacattttctggattttagaggatcacattctctgtcgaactctccttgattaaatgaagtcacagggtgaatatttcaattatttcaagcctttgtggtcagtgatctagtattcaattgacctgaacactgaaaacaatcatcatgcctatggctatttgctagggacacgtgataaccacatgcaggaattctgggtaagagcccaggacctcattccaaccctgcctttcccaaatacctgccctgtgagccaaatcgcttaatcttaggattcttttgtttcttctttataattttaaaaagcacagtacctgctttataaggttttatgcatgagatggtgcccatcaagtgtatagtggctggtgtgtgataattttgtaaaagcgtcacatggcagtacatcagagccacatgacatacatgactgctgggagctgggaaacacactaggagcagtggtgccttccagttgtcaccagagcaggcactgaacctccactcacaatgctcgggagactcacctaatgccaaagccagggtctagataaatcctgcttgacacaagaccatataaagagagagagaaatataggctgacaaaaagtggctacaaagcaaggcaaattcaagtggctactggtggcgtgtataaaacagaactgccctgggaaaggaacaatcaaaaaacaagatggtgcctggggaactttctcaaaagtgaggaaacaataagctatgtgtgctccttaaagcaaagatatggcaaagatcccaatccatctcatatttttaataaatatgtcattctaatagaattttccttggtacttaaaattagattataaattttacccttaggaaaaaatatagttaggaaaaagaaggatgattgaatgaatgacgaaaggaaaaataacaagtgaatagtcggtaatatgataatatgataacatgcttaatcacctctcaaagaaatacagctccaagttacataatcctggattccacatctggaaacaaggagcactccctgtatttggagtttattataaatataggcagaaaggctgcaatggaattcagaaggacaacccagtagaaaattgaaacctggaaaaaaaaatcagcaattccataacacatcacttatagacagccccacgctgcccctggtaagtttttgcagaagaacatgaaaatccttagctaaggtacaaacaagccaagtagaggtcaacacatttgggaaatagtggctccacactcctaaatgtcaagggtgtgtgtctggggggtgggggtgggtggggaaggattgtggtatttcagggagaaggaatgtcggatgtttgaagacagcactaagtgtatattagagtgagcactgtcctgggcctctaatggactccattctgagatctgtgtcagaactgtcaataacccagcctagcccaaaactgttaatgtatcacctcccacccagagctgaccctgcttctcagattgcttccaggcaggtcccctgcagagaaagccgaaggatgggtagacacacaggactggtattggaagagatgcttcatggtttatttcttctgcacctgccctcaaagcttgaaggcagctcttgaaacccttatttccaagaaaggggaggaacttggctgtggtattatgatgctccctaagatcttgcagtctgaaagctggcttggagccttgttttcttctgccatctccagaatcccaaatgtactaatcaagactcccttgttcgttctaggataacacatgactggaccacagggaaataaatggccatgaaaagatgacaccctgaagccagacaatattctcctaacaaagaaaggggaagagttaacagagggttaaaccaaagacggtttggctagagagacagcatagttgaaccttctcatcagttgtggctgtaacaagaatttgcaaagatgaaggtttatttaaggaattaaccaagaaataagctgttctacccacagtcatcacagctgccaaaactcaaattattttcttaccctgagatgatcctaggggaaagcatgattcaagttctaccagagtgtcaactactccctctgggcttgtgttaactcttttggaatattaaaattgtttctgtagcctgccagaacaaagctgggttgttgcagtagcctcccagatgaggttagggtcattgcgggcgggagggagtctttctcaccttttttctttttatcttatatacacaaagttaaatgactggatgaaagccccagatactggtctgtagaagtgtctttgttctcatggatgcactgttacttcctggactttgggggactgaggtcttttatagttaaagaaatatacttaggagattggcctggttggggctctgccatcacagtctctggagctgtaacctaatcacatatccttggcagcaaaggcaagatcccctgctgacttgtcaaactctcatatggatgttaagaagattaagataatagcatgcctaacatagctaataagagagatttaaaacaattggcagaaacagattgagttatgaaatgcttattatggatgattctgtgtcacaaaaacagcatatagggtcagcttaatttcacacacaagtaaggggagaagagatgccaatgatgacgaggcagagagagagagagaaggagagagagaaagagagagagcctgctatgccatggccagtgctcaagtgggcagactgatactgagctctgctgggattgcccagtaccaaccccctgcccacaccccaccactgatcatggccagtttggaaagggtgtagaggtcacggaagtgtcaggtcacacccaatgtcctagacactggaggaggtacatctgtgtccaaatatcctaaatagattttcctaaatttgagaatagtcacttcaatctttcttctttccagcctgggtagatcagccacatgccaattgtcttcttgttttctttccaggacaagaagaacatagtttcactcgcagggaatgaaggacccttttgggccttggggggaacacgctgcatgcagcttcctttccatccttgcatcttctttgctgtctagtgctccttgtcatggtctctggggctgtcagcagccaccgcccctgcgctgtgggctccctgccctgtggagtcctgtgctccaggctggctcccacctctccctaagagacacctgggcctggccgtgtggtttgtaggctggagtggggacagaggcctgctggtctcaccccacatttctcatccatttagaggaaggagccatctgagaatccagggacgctcctctggcccaccagccttctcttccccctcccaatctccccttcctttcacaagggaagggaggagattcggtttgcagcgagaaatgttgaagttgggaacgaagtctttggagtggattagccctttgatcttcaggtgggatctccaggtgggacgctcatggtgagaacaagcagcaggctgctctcctgccttgctggtgaaaccctgtcccagacgcctgagaaagtgacctggcaacatcgttaaaattgcaagcacgcattccctttaaaccagaaatccccctcttaggaatctctcccatagaagtaaaagcatctaggtataaagggacctctgtaaacaatgtgcactctttgcggaggcaaaagtctggaaactagataagtatccttgatagaggaaaggaggaatacaatagactacagacaccgttcagagaaaacttaatgaaaacactggcagacacaaatcaggttgtggacatgtgttttcttgggagaaattaaggaagctgaagatggtgtatggcacaagagatgaagaggggttagtcgctcccaacaaacaaaaaagaaaagaaaatgagaaaaatgatgacactttaacagttcaagcagattgtctagggcagggaagtagactgagaaacaggctctgggaagtagactctgagacggaggtttgcctgcaggaggatgtgccctccttgtcacacctgtgggggagggaggcaagcaggatggggtggaaggagaagctgggctgccatgcagtcaggacaaaagcctcagcccatcccggggaaggcagcattgctctggacagctgcccagtcattggatgttggctgcctgcaggaagaaggagactctcatttgcagtgggcagccaccaggagtgagacacagttgggagctgccaggcattggccctcccagcaccatagggaagggacacagaaggcacactgcagcgcccattgcacgggtgcacgatcacatgtatgtatattagtaaagttatagatatacgtgtgtgtggaaatcgataaaggatgagagtaggcagaagaaaagagggtctctgattctcagagtataaaatttatttctaacactggtgagtctgaagcctcactggaccccattccagtgggaaacagacaagactctcagcctgggcagttacagcagtgacactggccggatgatttcccttgacctcgccacatggaagccatgcaacccagccccccatcgtcttagctcctgagaactctgactgccttctatttttgaatgggttgggaatagaaccaagagataaattttgtctcccttttgcttgtcagggttgggtaccttgaatatgggttcaaactggaaccaaaaataaaattcaaagtaaacacctcagaaggacacccagctatctccatggcagaactttgcatagggtgctggaaaattcaggcaactgctctgacccagcacaaactaagaagctcagcaatgactcagtcactcctcttgagagcaattaagctgctgtaaaacatgtaggaacctgataagtagacatacaatcagtccctaaatcccaccttctcctagcaccatattgctaaggcaaagcagagacaattcattcggcttgcatattttcctcaagactgtctttcatacttctctgaatgagattttgtttctatcagcaagtgtttaagaaactatggagaggaagaggaagctggcatatggcttcaaaataacttatttctgttgacatgaaaagaaagccttttatatttcaataggatatcttcatgtatttagcattgttctggaaataatagttaatgcaatgagccaaggaaaaggtgagttatatgtattgagaaggaggaggagcagagttagtaaacattgataatttttgtatgtctggataactcaaaagttattagctggaaaaagttattagtagtatgtaataagaaagcaggaaggtagctgggtaaaggttaaatatattaaaatctatagctttcttatatgccagcattaattgtaattagaatgtaaatattctactcacagtagcaacaaaactataaaataccaagggatacatttaataagcaatgtatacaataaacaatagagaaagctacaaagatgaactgacttgaaagaagtaatacattctgggatcgaagtctttaggttgtgaagatatcagttttatccattctgatttataaattaacagcatttcaacaaagagtttacttagaactagacaaaataattctaaattttacctggaagaataattataggtgaaaaactaaaatgagatgggtggaaagggggagcttttcctatttgatattaggatgtgtttttaagttgcattcatctacagataggaagaccaaaacacaaatcaggacatctgctgattattcagccatttctgatgtttccagacatggaaattaacattctctctttcctcagttgaccatagattctcatgagtgttatttagccttgtagagcacagcaatctccacgtagatcccaccagcccagaagagccatcagcccctgcagtcagatagttcttcactttggacctgtattcctctgacaatactgagtgcatctccaagggcagagtatcaaagcatgtcctctggctgggtctacaggacaccaacatctggcagagaactgacccatccagttggaactctggactttttccacttccaccttttgctggataggtaaaacatacagacttctattttaattcttcacttgtttcctgggatttttgatgccacatataccaagctctcaaatcatcgtgtaaagggccagtttttctcaaatccattgtgcaccatgatgttttttaagtgtatgaaaaataaatcataaacaatgaaattaaaaagaaagccaatgtcaagcaaatacaagcccctatttttattactacatttcatagaaatcaagttactctgtcatgttgccgtatatgtccttaaacacttattttctttggtggcctgacccttatcaactgactgcaccattatataactcatcacaagggaactggctactactttagctagcaattctttatgccttgtgatctaagtaacaagacaatcttacatttttataacacttaactttttgtagtgtgcaaattcttttcctctccaacaacactattttgaggtagttggggcagtttttacaaacccaatttctcacatagtgtattagtctgttctcaaactgctagaaggacatacccaagactgggtaatttataaaggaaagaggtttaattgactcatagttccgtagagctggggaggcctcaggaaacttacagttatgctgaaaggggaagcaaacacatccttcttcacagcgcagcaggagagagaagaatgagggccaagcgaagggagaagccccttataaaaccatcagatcttgtgagaacttactatcacgagaatagcatgggggaaactgcccccacgattcaattaccttccacttgtccctcccacgacacatgggaattatgggaactacaattcaaggtgagatttgggtggggatatactcaaactatgtcaggtaggaaatgcaattcctcatagagatattcagtgacatggtcaaaggggttactgacaaagctggaatgcaccctggaatgccctccctgattcattattttttgttatttccacttctttccccctgcttttccaaagcatttttattcatagttaagtcatgattcagggccccagggtgaggatcaccatgtacccaggtttccctttgcctgggagaaggatgaaggacataggaggggtaagatgcagccagttcagatctttccaggaaatgtgcctttagcccagctgtcatcctagactgaaacccaggagcagggcagaagaacttgtacacacactggtatcattcacacatagagacatcacacccttcagcggttgttgccttctcacagaggtggaagtccaggaagttctgccagcagttcctagtctggttggggaagcgtctgtcaaaaggggcagtcttgtagttcttgattttggtcttcatgtcttttgccaaggtgctgacttctaaagatgctcatgatgcagctggtagctcagtgtgaccctcagcaaagacatcaactttggacctcattccactctttaatgaatctgtttatgtctcagttaatggagctactgatgactgactcagtgagtctaatcccatgaccctgactgacaaagcattgtaaatgctaatcctgcaaaagtcccttctactgttatctacaccgtgaagagaaaacccaccaaactgaacaatgatgatgttcttacacagcagcgctgcattaggaagaaaatttcaaataatccatcacctagtgtgaatatttccacaaaacagcaaatttcactaaaaactctcattaaacactttaagaagagacgtgtagcgagttatttaggctacataaaccaaaaccaaagtgatattgttggtctggtagttctttcttaaaactgcaggtaacacatataagagcaaataagtagcgtcttataggccaagtttacaaaaataaactacaaagagatgtgagaaattttaaacaaaatctctgctcattgttcagaaggagattctcttctctgtgctcttcaggaggggccagcagtggtatttgggctgagtggcaagtgaaggggagtgcttaggtcccttcagactgtgtgccagtgaatgcagttccaaagagctgagagaagggcaaacgaccagcccaggaaggcagcatagtacaggggaaagcccttggttccagaatccaagggttttggtttgaatctcagctttgccacttcctaactgggtaatgggccctcacctcactctgcctaatagaactgtgattactaaacaaaggtagatatacaatggctagtatataagtgctgagagatatttgtccttgtcaatagaaaaaaaaaaagcatatagaattcaccttcctctaccaggcatgtgcctggacctcttcaggctttttaaaaaagctttttaaatttatttttgtctgacattgattatgtgggataaaatatctccaagtgcggtgcagagtctatatgaagaagcacagataggaagagaagtagtcacattaaagtcaaattaagagtcctattaaagtctacaatagccaggctgggcatggcaactcacaccggtaatcccagcactttgggaggctgaggagggcagatcacttgaggccaggagtttgagaccagcccagccaacacagtgaaaccccatctctattaaaaacacaaaaattagccaggtatggtggtgcatgcctataatcctagctacttgggaggctgaggcacaagaatcgcttgagcctgggaggtggaagttgcagtgagccaagatggcaccattgcactccagcctgggtgacagagagagactctgtctcaaaaaaaaaaaaaaagtgtacagtagccattgggctagatagcctgaggcctaaccggtgcccacagtggggatgtgttatagcacaaggaaaaaagctttgctttatgagagaattttgcaagggctattctgacacacacctgagtgagctgacatgtttggagaaggctcaatgagtagaagctcagtacctcccatgtatgctcagaatgttcccacttttactgcctttgattcctatctcaatacattactttagtctctaccaaagtaatacggaagacagaattagaattgtcttttagtgattgtatgcagtgcaatgtacaaccaggacaattgtgttgtttttccggcttgagttgctccagttggctgtctataccaatcacaagacttgtatttctcaggactgtgcaaagttaagccaagtagttgagtacaaaccaggacaggcgtttaatgatacagatgttctacaacatgttttctttttttcaggcaccagaaatctatgtggttactttctttagtttataagaccacatgtaagtactttggacaattgatgtatttttcctttttacattcagatatttaacaaagcaaggcacaggtctaggctctgtatgaatctatatctgaagaagccaagttggagcagcttacaagcagatcccagtcactgacaccaccttccgaggcttagtgatgagtagaaaatccagacccttcaccccgctgctcatctgaaatagaggacaataactggaatctctatgctctccaataatgcaggacttgactttgagtctcttcaatttaattgaacaaatatttattcaggacttactactgtgcttaggccctgaggattccaagctgataagactgattcaggttaggcctatggaatacaatttagagcttacaagatgatcacctaagccactttcatcattcagctggtgaagaactgagccctggagagaaggaagcttcccaatggcacaaagcaagggagaaccagggtcattcaaaaatttgaaatggtaaaaatgtagatgccattactatcaaaaaagtggtagaagataaaggtactgtgtgcaagtccctattctgtagctttggccttagatgtggatccattccttacctggacacagaggaaaggcctccctccttaatgtctgcatagggccaccccctcaggtaaaccaccagtgtgtcctctaatgtgtcccctcagctctggaaccagagttaaggccacctgaccctcaccatgtgactagctctatcctggacaagtcagatattaaacccagtataatgaaaaccaggtctttacattagagatttttatttcaatagatatcaagatagacttgcaagcaaatttgtgtatttaaagcatatgatataatgatggactatgcatgctaattattagaaagtaataagggtgctagttaagtggtgcttcacttctctgtgaagaattttttttttttttttttttgagatggagcctcgatctacgcccaggctggagtgcagtggtgcaatcttggctcactgcaacctccgcctcccgggttcaagtgattctcctgcctcagcctcctaagtagctgggactacaggctcctgccacaacgcccagctcattttttgtgtctttagtagagacggggtttcactgtgttagccaggatggtctcgatctcctgaccttgtgatccacctgcctcggccccccaaagtgctgggattacaggcgtgagccaccatgcccggcctgaagaagttttttgacttcctaaacttcaaactggaaaaccagcctcctctgactgtacctgtacaatgattttggtcctttattgggcttaattacatgctagtctccaccttgaagtcagggtctgttcctgtctggcgcctggtagactctcaatgtttcttgaataaagtaaataaaagatattttgagatcttagtccactctggggtggcttcccagaagagaaaagctgggatttattttaagaaatggaagtaatttggcggaaggaggcatatttcttccttagtgccctcaccaagcctagaaaataggagcaggtcttggggtgggatggtgggaagggtgtgtggggaggaaaggcacaaactatgtgattcccctatggctagagagaagctctcggaggcaggctaactctgccaaggtcaaggagcaaacaggaatggaagccttgaccctcggtccagcctcacaccacatgttctctataggagacacctttgtacggagctttgcactgaccttgagaaataatttccatctggaattctgggtgaatcacaggaaggcaatctgcaatttctcaagtttgcacttggctggggttgttgaatctatgttgtaacccttatgaaacactattgctcaagaacattcgaatggatgcaacatttgtaaattaaaagcctgctgctttaattcccttccaatggacacagttagacatatacagaagtcacaactggatgcagctggaggtttgactttgagaggatgggagactggaaatccctgggcatttggtcagcacagtagcagagtgctggggtttgggaaagtagcggttgggtaggagaaggtgttgcatgcaatatttttctttctggtatttgtcccgggagatccatattgacacctgaactttgtgacacagtcgagccctgctccactggcttctatacaaacaacatgatgcaaaccagctggggccaaagcagttaccatggaaaccctagactttggtttggaaagtaaaagtaaaagacatttatgatgaccacagcagtggtttgtaccaatgcacttcttgggaagtttcttttttatcctgaactttagcgttctttttttttttttcttgccctgtggaatttggcaaaagaaaaatttaaaatcagattggaattattaccttccccattaaatagctaaaacaggaagtcttgatttattcaaaccatatttgctaaagacaaatttaactctaaatggagaaaccgcttaaaggtcaagttttgtcttggatactttgaaagagttgctaagcatttttgtcccctatggaggctgggttgacaccaggaagtgttatttgtgttatttcccctcaaacatttttccacctctcagtaatgacaggagaattatggctatagagagcaaacacagccttatgtgggcatgatcacagttgtagcaagccagtcatgatagcaggaataggctggttgcatgagtgcactgggtgaagactacagaggacattaagggcaccagagggaacaggttcaatttctactctgtcacttacttgctgcatgatcctgggccagttacttaaccaccctctaccacagtttcctcaggttggaaatgagaatcaaaatgcccaactgcccccaaatgttcacatggattcaatgaaataaagcacataaagcataaactgaaatccaaatggaaagcaatcacaaaaagaatccagtggaagggaagtgggaagtagcaggcagatcacgctgacaggttggcttcaagtgaccgttccaatctcagaggaccacagtctcaaggccacctacagtttcctttaccacccactgtctgagccaccaaagcctaccccacccttgcacctcctttcttactcccttctaactgtgaaggcatcgggctttcccagatatcctttgcattcaaatcctctcaaccactgcctgcagattcccctccttctgtactcatttttcttttcttggaaaaaaacaaaaacaaaattggacccttggtggagcccttgatggcgacagcacaatctttcatccctttgctttgtcctctcaggtcctggctctgttcctcacctccacttttatttccacatcctccatgacaagcctcctgtccctaacattcagctgaaactgttcctagatcccaaactcctaccctagcacaagagaaagctggtggcattcctatttagtgacatctcttcccaactctgcatcagctttgataggtcacaaatgacctcagattactaaacgctattttttttctccttttctttccccttgacttctctgctgcatttgatattggcgccactttctcttcactaaaattctctcttctttttgttgccaggattttatgctgtggtgagtctcccacttttccaaaacgttgtgcaagttctgcttgttttttcttctgcctactgatgccaacatattctaacattcagccctccttaggagatgacccattcccttagctttgctattttctattcccatgactctcatctcaagagctcttcttcaccaaatgccaattatttctgctgatctctaggtcaaccctgtccaacagaacattctgagaggatggaaatgttctctgcctgggctgttgaatgcagtggacattagccatatggagctatggagtacttgaaatgcagttagcctgactgcaaaactgaatttttaattttatctaatttcaatttcaatttaatttattacatgtggctagaggctaccatattggacagcatagttccagatagtttcacttaaacaccatcatttcaggcaaaatatgatcaatactaaaggttttctggaaccaactcctctcccagcctctctgtctatggacaactaatccctactgcatgcaaagctcaaaagcctcttttattaattccactctgattcctcagacgcagtctctgattcccattgacctgccttgaaatatccctgttctctccccgaccttctgtattttactgccacacccctgagcaggtcctcattcaaacctaaacagccagcctgaatctctcacttcaacacaccttgcgatcactgcagaccggatcttattctaacactgctctgcaatgttgcttccctgcctcaaacccccagtggctccccacttcctctgatttcatggccaaaacctttgtctggttttcaaaaagacacccagaataatatcatccctggtctgggtcaataatattgtcccaccaagtctggataataatattgtcccaccaagtctggttttccatgactctctctctccctctctctctttctacacacacacacacacacacacacacacacacacacacacaccactcaaggattatctcacaagctcatgaatgtgctgtgttcactcctgtcttggagcttctattggcttttcaaatccgctattggcttttcaaattctacctttcaagacccagttaaagactccttccctctatggaaacttccctaattaagacctgcctggcatatctcccctctggattcctagaccatttataatgagtgttatcttgtcctgatgactattgtttcaagtgtgctatccttttccccagattagacttgaagaaagtggctcttcttcttcctgacctccagaagacttagctcagaaccgagcccgcagcagatgctcagtgctttgtgaacatgtcttgattcatcagcaagtgcaggataagaactggatgtgacaacatctgagagctcagtgaacattagactcgccttgttaataatttactccctttgtcccctagtttcctgctcatccctctatttctcctggctcttttcagcttcaattcctctcatttgtccacttcttccctttgtccagtaaaccacatgggctgatcagggttggagtagagagtgtaggattgtctattttctcttggaactgatggccatggtgaacaccttgcttgccatatgatcaacatggctctatgaggcagttaaaactatgtagacaaaattttttttgtcagataaaatgaggataaaaatacctcctcatcaacatatagaggaactatggaattaaatgaataatgagtaatgggctaagaatataggattggatgtaccagaatcacagtgcaactgcctcatggaaaagctgggcattttcatcttaagggatgatccagaagggcaaagtttaaaacaaaggaactgattcaagtgcaatattttacattgtgtaaatatctgaaggaattcacaaacggaccacaatggctgcagagacacagtggtaaagtgcttaataaattggcgaacacgtgttgtgccataaatgttagtgcatgaagcaagttatgattatttgtttccctttgtgtttttctaatcaaagatttaaaaatcatgggagttttgagcatcatgagataacaagtattgtgatacaggtccaccattccttttccaaaaactttggtattagatgtgttttggaaatcaggatttttcagattttataaaggtcatctggatcatatgttgtatattgtatactactaccagtgggatatgggtcagcaccctacaatcaaacacagaaatatttctgcaacacaacgtgtaaaatataaaatctacaaatggactcacctgagttcagattgagttcactgccaaatgagttctgataaggtcagattttggccccaaattattaatcgagaacttgcaattttcagagcttttgaacttaggaatacagacattgtgtacctgtcctattctacatcattttctttaaaaagaggtagtctttttgaaagtttctattaaacttttagagatgtaaaaaatagtgggtagtaattacagaacttactacaaagctacagtaatcaaaacagtgtggtactgtcataaggataaaggacatatgaaatgtggaatacaattccatttgatggaatagaatttagactccagaaatgaactcatttatctatgatcagttgaatttcgacaagggtgccaagaccactcagtgggagaaagaataatttcttcaatagatgatgcttggacaattggatttctacaagcaaaagaatgaaattggaagcttacctcctatcatgtataaaaattaactcaaaatggatcaaggacctaagtgtaactataactcttaggagaaactataactcttaggagaaaacataaggatacatttttgcaactttgtcaggggtgttcaatcttttggcttccctggaccacagtggaagaagaagagttgtcttgggacacatataaaatacactaaaactaacaatagctgatgagctttaaaaaattggaaaaaatcataatgttttaagaaagtttatgaatttttattgggctgcattcaaagccgtcctggccatgggttggacaagcttgaattagacaatgactccttagatatatgacaccaagaacacatgcaacaaaagaaaaagtagataaattggatgtcataaaaattaaagacagctgtccaccaaaggatactatcaagaatgtgaaagggcaacccacgaatgaaaatatttgcagatcaattatctgaccagggtctggcatccagaatatattaataacccctgcaactcaacaataaaaagacaaataacccaattaaaaaatgggcaaaggatgtgaatagatataactccaaagaagttacatgaatagccaaacatgcatatgaaaagacactcagcattattagtcattagggaaatgcaaagcaacatcactagagatactatttcacacccactaggatggacatcattttaaaaaatgacaagtaatggtgaggatgtagagaaactagagccctcaaacattgctggtgggtatgtaaactggggcgtttgctgtgaaaaacaatttggcagttccttaattagctaaacgtagaagttccatatggccgagcaattcaactcctaggggtatacctaaaagaactgaaaactggtactcaaacaaaaacttgtacatggatgttcatagcaatgctattcatagtggtcacaaggcagaaataacttaaatgaccctcaatggagcaacagataaataaaatatggtacattcatacaaataaatagtattcagtcatacaaaaggaatgaagtcctgaaacataccataacatggatgaagcttgataacattatgcaaaatgaagaggtatacacaaaaggtcacatatatgatcccattcatatgcagtatcaggaatcagcacatccatacagattgatggctgccaggcacttggggagtggggaatgccgagtgattgctaatgggacccagatttcattctggggtcatgaagtgctttggaactagatagtggtgatagttggataacattgcgaatgtattaaatgctacagaattttacaatttaagatggttaaaattgtgaattttacgttatgtgaatttaattacaattaaaacaaagtgagtagacaaatattgcctctttggggacctcaaggcatctggagacctcagggtttgtttggttcatgtgttttgttttgttttgaatcactagctaagatgttggcaacacagtaaacaaaagctgaacaataataataattgatgtctgctttaaatgtgctgtttctgatgtatttttgtaaatttcaggaattcctgtagcataaaccagagtttgttaatcttggcactattgccattttgggctggttaattctctgttgtgggggctgtcctgtggttgtggaacattcggcagcacccctggtctaacccacacaatgccagcagcatctcccaccccaattgtgacactatgacagaaagagatcttgggccaggcgcagtggctcatgcctgtaatcctagcactttgggaggccgaggtgggtggatcacttgaggtcaggagttcgagaccagcctggccaacatggagaaaccctgtctctactaaaaacatacaaaaacttagccaggcgtggtggcaggcacctgtaatcccacccacttaagaggctgaggcagggcaatcacttgaacccaggaggcagaggttgcagtgagccgcgatcgcgccattgcactccagcctgggtaacagtgagacatcgtctcaaaaaacgaaacaaaaattattcacaatagcaaagacttggaaccaacccaaatgtccaacaatgatagactggattaagaaaatatggcacatatacaccatggaatactatgcagtcataaaaaatgatgagttcatgtcctttgtagggacatggatgaaattggaaatcatcattctcaggaaactatcgcaagaacaaaaaaccaaacactgcatattctcactcatagctgggaattgaacactgagaacacatggacacaggaaggggaacatcacactctggggactgtcgtggggtggggggaacagggagggatagcattgggagatatacctaatgctagatgacgagttagtgggtacagcgcaccagcatggcacatgtatacatatgtaactaacctgcacattgtgcacatgtaccctaaaacttaaagtataataataataaataaaaaaaagaaacaaaacaaaagaaaaacactaacaaaaacaaaaacaaacaaaaagaaaaacgtctccagaccttgccaagtgcctcctggaggtcaacatcacccccgattgagaactactaatgtgacctctttaggaaaagtttattatcctgggattttttcctctcctaaagtttctttttaaaaacccatttctgagattgttctttagtaatttccaaatgacagcaaactcatgaaacaaaacaacatgaaaattccaggtaaatgtccaaaacctttttcattaagaggaactaaactacgcagtccacttgtagacagtaggtttctcactggcaacgaatgccctggcaataagctaaatgtggatagcacataaaaaaagtgaatgtgcaatgttcccttttcaaaccctttttgggcaaagacgactgctctgccagcattccagtataatgacagctcatgtgccctttgtcaaccttgcctccttctcctttgaaaatacaaaccacacttcttcccaaacttcttctgataccatttaatgagtctgggatcagacactgttagcacagagagcaacctgtgctccagatccccctcagcagccgctgccagcaggaagggagggctgagtgttcaggacgcagggttccctggctgcttcaccagcgcagtgctgcctttatccattttatgtcttggatttctgagtgggatttattttgcacaaagagttctgaagctgagaagtttgaaagccactggctcaacccaagcccctctcctacagatgaggacaccagagtgcagagcaaagggcaggaccacgtgtgattccagggcttttaactgtagacaggcccctttcctctgttacagggaaggcagccaggcagctcctgcaagatgtcactaatcccttgcgtgcctcagtttccttatctctacatgagcatagcaacctccatcttcctggctacttctgggatttaaattagacacagtaagtgccatgcaagtaccactaatatggatggaaagtttgtgtcctccccaaatccacatgttgaaaccctaaccaccagtgtgatggtgttaggaggtggggcctttgggaggtgattaggactagatgatgtcacgagggtgaaccctcataatgagattcatgcccttatacaaagaggaaggtaccagagagctctctctctctctctcttcatcaggtgagaatgcagggagaaggcaaccatctgtgacctagcaggagaaccctcaccaagagcctgacaatgctagaaccctgatctcagacttccagcctccagagctctgagaaatcaatgtcagctgcctaagctgcccagtctatacctgcccaggtattccattatggcagcctgagctgacaagtctaccgcttgacatcacacacatcctcaggtgtgtgaatggtttcacttcttctttcctaggaaaagagtcattaaactctacacgtttcacacaatcctcttgtgatcacagccacaagggaaagctcagcttactgaactgtgtagggattctgttactgtctcactgcacagttgtcttcctctaactgttgagaatcaaaggctataggaggatgggtctgctttgtcttgaaccacaaacttctgaaggactgaaggagagaatcgcactgcgggtgacccacttctgcttcacactctgatatccccatgaaaaggagcctgcacacaggcagtgaattccagacggagctgaactctcaggtcctctttctaaattctcaatctatctaaaagaatacacatacaggtgaaattttacctccctgctaaaaaccttagggaaagccaaagttcataagccagaatctctgagaagtttcttgaaactatagtttggttaggaccagcctgaataaaaaactgatgaatcctcggttcacatcaacaaaagacgggaaagacggaatggctccagtagcttctcaggaatagccccaggggcttgagagagcagaaactgcgacacacacaggatcagggccagcttgtcaaaggtaaatctcaatgcttacatccaggcaggatgggaaggaccctgaactttcccaggcaaggtcagcagacaaaggaggttctctacaacaggtgcccaggcggtcagtcatgccacccggaggagagggcactacacaccctgcaccaaacagacaagagaaacagcctttgctgtgcaaaatcaaaacatgttacttccatctcttgaaggataaagagttctgtactctggcagattcgaatcacaacaaagacaatccatttccttctccccttaatctggatctgaaagatttgaagaggaacctacccagtttcaaacaaagcccatttcaaattttaataccaggtcaccctctatgaggttgaagaaaaagagaaaaagtactgttcctatgaaaagcttcagctattcaatagaggagattgatcccaggaatcagagcaagtgtacacctttaaaatggtgatgcggaggatgatctctaaattgtattcaaacaagacttaagcagctattaggctcacaaaacaagtgtagggggtgacgaagatggacagtgtgcccaccatatggagtgggatggagggaatatggagattgtgtattacaaaaaccaaataagtaaagtggaacatgaacttgagaaattcaaatggaaatttaaaaaaaaatagtaaaaaagtgactaatgagagagaaatgcaaaaacaaaaaacaaaaaacaaaaaaaaaacagggcaggtataggaattgaaattccaagaggaagatcagagcagaggacatcatcattaaaggaggctgcctttggctttagagcaaaaggtgcactggatctcaagcaatagcaatgaaaagttaccccaaacagaagtccccagtatatatactttttaatttaatagagaaaaaaattttataaacatcttagttgaaaaataaatacacaaagagagtacttgacaaaaaaacaataatcaaggggacctcacgtcatttatgaagcattaaatgccaagaaacaaagaagcaacaagagtattttgaaatgcaaaacaaacaaacaaaaaagaaaaacaaaaccctcacttgaattctatgtcacataagttgtctttcatgtgttaaggtttaggcctggaagggctgagaaaatgtgttttgcttatatcttttttgttgttgttgtcagagacaaagtgttgctctgttgcccaggatgcagtgcagtgtggaaatctcagttcactgcaacatctgcctcctgagttcaagtgattcttgtgcctcaggctcctgaatagctagaattacaggtgtgtgccaccacgcctaatttttgtacttttaatagagacggggtttcaccttgttggctaggcttgtctcaaactcctggcctcaagtgatccgcccacctcggcctcccaaattgctgggattacaggtgtgagtcactgcacatggcccttgcttatatctttataggtaaaattttgtttggtgctatagtcttctctaatataataataaatattttaaactttgtgggccatacagtctctgtagcatctacccaagtccaccactgtcgcatggaagcaccacagacaatatgtcaattacagggcatggccaacctagctggtagaactttactcacaaaagcaggccatgatttgccgacctctgttccatctgggagattaagaaaaatccagagcacaggagtgagtaagtcataatatataataggaggacaattggtaaactaaattatagagagatacaaaagacaggagaggcaatacaaaatttaatgaaaataatctagttttaaaatgcactattttattaactaaaagatagaggttttaaagagaagggaaaagaagagtgtgctaaacttctcaccttccatgggcaaaggtgggtggtggagtaacagagagaactgaaggtttaaacatgcttttgaaaaactagaaagttatgtctagtaaaattaaaaacaggagacaagctttccaaaccaccacagaattaaaaagcaaagaaaaaagttacccgttttacgaaagactgaaaatagtgaaaacgaaggaagcatagagccagaaagcatatgataagttgacaaaaatcacaccaaataatctgtcacaataaatgaaaattagttaaatccttattaaggacaaatacccatattagaaacatggattatgagaaatccatttgatgtgaagtacacaagctgctatataaaatggtgaacaaatgtgaataaaaatagattagagattgaaatattatttttttaaatgtgcatatccaggaaaaataattaaatagaacaaaaagtctatctttaaatgaagatattattgatttgatcttttatgcatgaagcaaaaacataaacatatataaagcaaaacttgttaaaaatgtaagaaatagtgggaagaaacctggtagcaaagggaaactttatcatacttctctcaatatttggcaagtaaagtatataatagataatggtaagataaataaagattaatggataaagaagatctggaaaacaccactattaatgtttagttaatatatacactaaagattaaatctattgtgtattaattattgattacatattaagtcattaagaaaatctcaataagtcccataagctaaaaattattgagctcacactctctgaccacaatgcattaaattagaaattacatttgagaaagtgggagataaaattaccaatgattttcaaatgaacaaacaacaacaacaacaacacaatgaatcctttcctgtctacacaggacaagggaaatattaaaagcaggaaggcagactgattggatgacagcactgcctacccaaacataagggaagaaactaaactttgcgtagaagcaaatgtacagcttggattgtttttaatcttagacaagaaagaattaaaatagatgaactaaacattctgggtaagctaatattgaaaagcaaaatataaccagaaaataaaagagagaaatctctagagattacattaatgtactgggaaagagattaaaatgactaataaattcaggacttggattctttgaaaaaaactaataaaatatacaggctttcagaaagtctgagcaaagacaaaaagaaagaagaaagatagcaaagaaataaaaagttacagaatttcatgtagaagtctatgctaaaaacttgaacctcaatgagaaggcaaatggaaaatacgaaaataaagattatcaaatctgacgatcagaacagaccactatccatggaagaaatagaaaccagtctcaaagaattgcatccataaaaggagctgggcccgaatgttttataggcaagtttttcaaaccttcaaggaacacataattcttacggtatttaagctgttacagtttatagaaaaaaaatgaaaagtgtcacaattcgctttatgaaattaacataaacgtgctaccaaaatgtaacaaagacagtgcattaacgtaaaacaatagactcatttcacacagaaacacagatgcaaatgagaagtgaaatatttcctgtgatacagcaacatgaataacggtgatgtcacctgattgagtagaatttaatccaagaatacatggaaaggttaataatatgaaataaaattttatcaaatcaatgtcaatgaaaaaagattatattgatggatatcaataaagcaaatgtttaatttaacaaaattaaaaattcatttttattgaataatattaaaaatgcaaacaaattaaaatacattttaaatctagatctgtatagttttgtaaactctagaaagatatttctttgatatgatggagtatatcaatctaaaaccaatggacagtgtcatatctgtcaaaatatcaaagcagcatttcccaacatcattgtttaatcaattttccaggagatgttagcagatgtgcttaaaactaaagtctaaacaacagttcaaaagtagtttgggaagtaaatggagtgacaaaatgaatccagagttttcttggcagaatgaatgtacaatagacaaaataattttgaaaaagaatattcatccaggccttaacctagagaatattaaaatgtattatgcaaccacagccattaaagtaatgtgacagcaatactagagcagagagacagataaatggaaaagaagcgagtgtattccaaaatagatccaaaattctttttaatataacaaatgtggttttccaaataagaaaggaaatgatggattatttgataagccttttgagactatctggctaaccatttcaaaataaatactgtgaggcataatctaccaaaatacaaacatgaattccaggtagattacaaatgatgctctaaaagaatgaggaggaaacagacttacattgtggaaggtctctctgagcatccctgagaaggcacattcaatgaaaaaacatgaaaatatttgactatataaatattttaaatgtctaaacatttgcaaaaaccataaaacaacaaaatgcaaataaccaagtggaaaagatagttttaaatatgtataaggattataatattttaaaatattcctcatctttattcttttcttagtaaacctctctctctctctgcctctctctctctctctgcctctctctctctctgctgtccacttggctttgctattccatagaaggtggatgccactctggaaaggaggaggagtgtcccctttagccagaacaaggaagaggaaagacttccctgtcttccctgagggactgtgagaaaggtggggaagaaggtagtggaaagaggcagttggcatttgttctgagccctctctctcaacaagagtggtaggaatgcctgaagattggctgggcacggtggtgcatgtctgtagttccaactactcaggaggctgagaagagaggatcacttgaacccagggttctaggctgcagtgagccatgattgtgccacttcactccagcctgggtgacacagcaagaccatgtctggaacaaaaaaatgcctgaagttaaagcggggcggggggggggagcaggcagaggtgctttctcccattctccattctgggtgtagtcagtcctttccatgagagccaccatacctgttaatgtggcagccagtgtggtggggtagagagtgtggtgtggaaggaacccaccaggctctctgtgccctgagactgggatggaaacattgttgagaatttggtgcaggaggttgtcaaagttgttcacagggctgcagggacaaagtgactccctggccaacagcaacagagccagtgtcactggagccaggaaacaatggagtcatagtcaaaccctctctgactactatgacatttgtaagcccctaggcgtggtcagtatcttagagggcagatctgaaaggccctgtgctgtggtctgaatgtttgtgccccacccccgaaattcctatgttggaatcctggcccccagtgtgatgatattaggagatggggcctttgggaggtgatgcagaaagaggccccagggagctgcctcactccttccaccaagtgagcacacagctagaaggtaccatccataaagatgaaggtaggtcttcttcagacactaaatctgttggtacattgagctcagacttccagcctcgaggattgtgagaaataaattcctgtttacaagccacccagtctatggcattttattatagcagcctgaatggactaggacaccaaggcatccaagagactgaatatgcaaagatgatgcataaattattggatttgaatgagtttattaaatttaactaaaagtgtgtgtgcatgcatgtgtgtgtgtgtgtgcatgtgagtgcatgcatatgtgtatttccatggaagtttgtagaaaagatcacatccgtttttggaaaataagctacatcttcttggcacatttgcatatagtgtgagaagactggcaacccaggatttgtgataaataagtaattatttatcttcaatgtataaaatgagcttaccgataaaaaaaaaaagacagaaaaactgctgtataaaaagtggccaaaaagcacagataggaaatttcacaagaggagaaatataagtgatggataaaaatataaaaagaaatgttcaaataagaacacatgacacggggaggggaacatcacacactggagcctgttgggggttggggggcaagaggagggagagcattaggacaaatacctaatgcatgccaggcttaaaacctagataatgggttgataggtaaagcaaaccacaatggcacatgtacacctatgtaacaaacctgcatattctgcacttgtatcccagaacttaaagaaaaaaataagaaaagaaaagaaacattcaaatagcgaagaaatagaaaacataaaaatgaaaagccactaggcaagtgtcaaactggcaaaccaaatagcagggctaaaatacagtaaacttgttagacaaagaaaatgccttagaaaactgtcctcatatccaccatgaaaccatgaggtgacagaacacagcaatgactttgttactaagtgactaaggattattactccatccaagtaataactcacttgtctatagcctgacttgaaagagtcagctattgttcaaagcattgttagagctcattgttgatgtcttctgagcctgcagcacgttcttttgaaaatgatggtaaatcttcattgacagatttgtcttgtggaaagagccaaaattaatttaaagccaagtctggttatactatttctgatcacgagaaagcttttctcataaatctaagctctgaaggcagtgacaaaagaggcattccagaacgatgtggcagctcacggaaataagttttttaaatggcacggtagaaggattgcacttggcaggatacagctccccttgtcctgcataaaggtctcccaactggtctatccacaatcttgttttcactaagcctttgataatcttgaaatgctgtataaactctatcatgtcattcctgctcatctttggataaaaacacaaacttgtataatggctataaagccttgtttagtctggttcttccctttccagcttcactggacaccagttatctcttggcctcttgtttctggccacagtggccttctagaaagtcattatggacattaagccagccccactaaagtcttcgcacgttctcttccctccctccccatttttgcctttaaacacctactcattcaatagatctggacttaatagtcaagccctccttcccagaaagacctttctaccctcccagtccaggaccacccttagccacaggacatattttcaaggcaccatttatgttcccttcattgctctgtacacggttttcgataacttagtgtggctatctgattaatgtctatctccttctggagattagaagcctgcagggaggcaaagatcccagttggttttactcagtgcattgcatgaagcctggcatatgggaagttctcaatataactgatggattaaagagaaatgtaatttggcacacttgtgaggtcggtgatctgcaagaggactacaatgatctgcccctctgtgtacacacttgctgctctcccatcaagagatgagtctgtctcgcttccccttgaacctaggctggtctcctgacttgctgtgactgcagaatgaaacagcagtgatgctggaccaggtgtgagcctagctcttcaaaggcctcacagtttctgccttgactttcttgggggagagctgccatgctataagaaggtggtttagaagggaacagaggccaccaagactcacagccagcttcaattgccaggcaagctgggtgctgacgtacttttgaccatagaatcatgagacatagatggctgctgctttaagccactaccttttgggatggtctgtggtgtagtaagagtaactgaaacgctggcttcttatcttaaaataaattctagccaggtgtggtgactcatgcctctaatctcaatgttttgggaggctaaagaaaaaggattgcttgaggtcaggagctcaagaccagcctggacaacacagcaagatcccatttctataaaaataaaatataaaaattagccaggcatggtggtgcatgcctgtagtcccagctactcagaaggctgaggtgggagaatcacttgagttcgaggccgcagtgagctatgattaccactgaactccagtctgggtgaaagaatgagatcctgtcattaaataaataaataaaataaaataaatcctaatggcactagtttttcttcacaccattatctctaagaggtgaaccttttccatgagaactagggaactgctccctttgtacctgcagtgaagcaaccctcaacccctggttatcttgggcatccgcagagggtttgggattatcatatatcattgtatgtacttgtcctttttccttgtcatttttcatatacctttgctaggtatctaattgttcagatgttctgctccattagggcagggatttatttgtctttatctccagtgattctatagcttcctggcaaacagtatatgttcaatgaaactgctgaatgaatgaatgaatcattctctgcctcattgcctccacctgataaatccactgccagctgtgccctcctcaaacatccaatcttaaaacacatttttctgctctatcaatgtgctgcctcctgttcttttataaacataatcctcaaatattctatgtctatgtaagccacatctcagcccaatgctgcctcctttgattcagtggcaacagcaatcaatggcttaggtcctataataacgctgggttttgtgtttaaatcagataacatatccagaattcagacacgtaactatgttttcagtgattgttgccttttcatcttctttccaatgctttctatttcttagaatgccaaggacatccacccctcatggcaacatctgcatgttgacatacatcagtaatggtctgtgaatcatttgaattctggtaagatgaacatttattaccatttactctgagttaggcactatgctgggcagctgacctatataacatcccctgttatatgaaaaagaaagcctaggtttaaatctcaggccaacagtttctccattcagcagcacactgcctctggaactagtgggctctagacaatgagatgaaatcaacaaagatgattcataggctttagatgctggagcttcctgagaagcagagttcttatccttccttctctttcgtaggttgaaggctgacaccgtcatagtctctctactcatctccatggccaaaatttgcttttgaaagcatttgctccaaagtataaatgactgttaacaactgcacatggcacccccctcccttgaaggcattctgaatttcaaccaaacatttaggatgcaaaaatggaacaagattagcaagatttagacttggaagcaggcaagtcagattcctcccaacagtcatgctattcaatgcagcaagcaacccagccttagtggaaagaagcttgggaaaagggaacgtgagacttctcacaatatacaggaaggacctttgcagtcaaatagcctactcacctgattttcctgggtcagtccctattaaacatgggtgtttcacttctcagctgtggatagcacactcatccctgccctggtttcagtttttaatctctttcctctcccgcagcctagtgcagaccgacagcccttttctccaaaacagcacgtcatatttaagaatgtatgtcccttgaatataataatatgatagtatatttattcttctgctcacattttgcatgaaaaacatacttaagacagttaataaaaaaacatataacatctcgttgacgacccagcagaagtagtgccatcttctttaagtctctgctctgtcaatggtcatgcatgtagaagcttctcagtgacctctcggcacaatgaactgctatattccttagcacactgtaataatatcattctgagcaccatcctgagcaccatgtaataatatcactctgagcacctatgtcatagacttgcaataattgttgacaatttgtctccttaactagactgtgaggcccttgagggcactgtgttttattcatcttttttattctgtgtagctgagagcctggtgcttattacatagccagtacattcttggaggaaatcatctcttactcaattggtgtcaggaagaaattgagagccacagactggcaggttcagggatcctttgcactactgagcagctactcagaccctgtgaactgtatgttccctacttccctcctgtcatatcatttttcttttttttttttttttagacagaatctcgctctgtcacccaggctggagtgcagtggtgtgactcagctcactgcaacctctgtctcccgggttcaagcgattctccagcctcagcctaccaggtagctggtattacaggcgtgcaccaccatgcccagctaatttttgtgtttttagtaaagacagggtttcaccatgttggccaggctggtctcgaactcctgacctcaagtgatccgcctgctcagcctcccaaagtgctgggattagaggcatgagccaccgcgcctggcacctcactaggatttaaaagaagcccagtgattccgagggctcctgtctaccaccacttctctccaccacaacatcttctcctccacactgctgactccctgggagagcaaatccaagagcgggctatgactagtcagagcatccacctcccctagatgactccaggacccaggccattgtttctcatctctatgcatagctcagccaccactgcaagctccaaactctcaggccacccatcgtcacctgggctccttctacaacctggctgtggatgctccctaacctgaccgagtctgtgtctcttcacacacacactctctgggactcacagtaggtcctcagcattgcctcctgtatccctcagctgcttagctcttagagaaaaacacacaaccctccttcccgctgtactttaatgttatgaccgtaaatctcagataggccttcaggacttcccagtgactctaccaaacttccataaaatgtttactgtcccactctcaaagatgaatctttcacaccttctctgaggctaaaactgccatcgttccccattcctgactctctcttagctgatgaccttgcttcatatttcactgaggacataaacatatcctaaagagatcactatctctctccctctgtctctacttgcctcagggctcacacactttgctctccttgtcacttcccaatgctccccttgggcactgaatcccgttgcctcttttgcctatcccatcagtgcctctctctatcccatcgttcccatcagaatataaatatcatgtcatatccccacctcccaccattgaaagctctctctatacccctccagctacaccgcatctcctagctccagtgtatagcaaaacctttcagaagagttgtctattttccctgttcccactttttttatcctttgttctttctagaaagtacacaatcaggcttttggttccatcactcctctggacctgtgagcctcacgtgccttcctcctatcactaaaaacctgcttactgccaaatctagtgttggctcccagtcctcctctaacctgacctctcagctgcatgtgacacagctgattactcctgccttcttgaaacattttcactaggcttccaggacatcacattctcctgatttttcttctccctggctactcctttgcaatcttgtttgctggctgtttctcctgtttttcctgacctgacccccagaggctctgttttttttttttttttttttagatggagcctcgctctgcacccaggctggagtgcaggcatgatctcggctcactgcaacctctgcctcccgggttcaagcgattctcctgcctcagcctcccaaatagctgggactaaaggtgcagaggctctgttcttatctctctttactctctttatcttttctcttgtcaacctctccattcttgtagctttaaagatgttgatatatcccaagtttatatctgtagcccgcctcctctctaagctccaaatctatgtaaagtgtataactccctacttgccatctctacttccatgtctaatgaatgtttctcaacacagtgatacaaaagaaaggctcatacttctcactccctgcagccccttgcagccacataactctttggttttgccagttttagtgaagtgcattactatttactcagctattcaggccctaaacctacctatttctcacacccttgtccacactcatcaactttacctgtaaaataagtgctgaatgtgatcacgtcttaccacctctacctgtctcacctgagtccaagatgtcatgacctctctcccctcgacttctaatagccttttaactagtctctgcttctgctcttgcccccaaacagccaattttccccccaacaaccagaatgatccttcaaaaatataaatgagactggccactcacctgctaaacacccttgaatgacttcccaccacaattagaataatatgcaaactttactttggcctgaaagaccccatatgactttggtgttgtctatctctccaatctcttcttgaacttgactgccccctccctgtctgtagttgagccatactggcctctgtgatcttcattgaacaggtcaggctctttcccatctctgtactcgctgctccctctgcccaggaagctcttcttcccagatcttgcaagctttgctcttcagtccagtcaggactctgctcaaatatcacctctttagacagaattttccccactacccactaaagcaggccctcattgtctttgtcactttctagcctctcatcctgttgattttttgatagtgcatgttaatcttgacattttaggatacaatcatttgcttatgtctaccctttccaaatacaaccgtctcattggcaaggacttttctgccctgttcatccaaagtgcctagaacagatggtccataaatacttgttgagcgagcacacgcatgaatacgtgtgcaaaggggctcaggtaaagagtgtaatttctataatttcaaagctgtgatgtacttccaggagcagagtaagtaataatgatgggcaggcacaatggaaggccaggtattggattaaggagggcctctctggcagccctacaggacagacatttctgcaatgatagaaatgacctatatctctgctgtctaaaacagtagtcactggccacgtgtgactatggagcacttgagatgtggtcagtgggactgaggaattgaggaactgaaagaattttatttaatttcaattaacatttaaatagctatccttggctggtggctatggtattagaacctgaagaatcccttcccatggcttgtgattgcaggataattgtgtataactcactgagttgtcgaggggactaatgaaataaaaagcttaggaaaatgtctggaacataagtggcacaaaaaaataatagttgctattattccacagagttgcaaattaaagtactttaagtatatgccatttaaattaggctgtaaagcacttgaaatggacttttattaatgttaggcataatgttttgttttttagagttggtggataatcgatgtttgggtctgtatttgagcttacaaactaaaaatagcacacaaccattttgggatctcattgaaggagatagatgtctattccaagtggatcagcttgctgatacttataatgagctaattaattttgacaacagctaatttagcatctgcaaaaattggatttgtaacattatgtgtactgtattattttcaaacagtgttatctgcaacttcccggatgattttggataagagaagtgtttgttttaatacttattattaaaataaaaaaataagtatttacttattggaaatactatgattaattatttaaggcttaaattggtttggacataaaatcatttttttttcttagtggctgaccataattccttccatactgaatccagaaaataaaattagcacagatatagaacataaacagaccattataacaaacccttatgaataacctaatgcaataataaaatcacacatttgtccagaataagcatggtacttattttcaggccaagagaatttgcattctgtagcagagtgaaaatggcattccacagtcagcctaagcacttggtggagactctgagactagagagagcagatgcatttaaattgaacacgtgcttataggcattaagaaaagttgacattcttattaaagagaccaattaatctgcatcagttggaagccactttacagtcgaaaaagtgctctaggacctaatataaatgagactggagtagaaagagaatgaaaattcacttttctacaagggagccttttctaattgccctagagctgtgctgtttgaaatgctaatccttcctcttccatcccggactgggagtctggggtaacagaagccgaggagggtgaagacccccagatgctaaagtgaggggtgttcaagacttaccaatgggcatgactaagaaaaaaggcagccagcagaggacgaagcagccgaccacgatgcccagcgttttggccgctttcttctcccgggagaacttgaggagcctcactgagaagtgcgtcttggtcttggcgctggccatcccgctgcctcctgccggggcgtttttccgatggatgcggagcgtcacttgctccgagtccgacttgtcggtcttgaggccagacttgaggccccggctctccctcttggccaccacgtagacgcggcagtacatgaccaggatgatggccagaggcaggtagaaggagcccagcgctgagaagagcacgtagcccggctcctcgttgatctggcagatggtctcgtcctcgggggccggctgcctccagccgaacaggggtccaatggatatgaccagggagagtgcccagacgcagagcagagccatgagacccctcctctgggtgacgatggttgggtagcgcagcgggtagctcacgccgatgtagcggtcgatggagatgatgcagaggcccatgatggacgcggtgcagcacagcacatccactgccgcccagatgttgcagaagaccctgccgaaggcccagtagcctaggacctcgaagatggcggagaagggcagcaccgtggaggtgagcaggaggtcggccaccgccaggttgacgatgtagtagtgcgtgactgagtgcaggtgtcggtgacaggctacggagaggatcactaggatgttacccagcaccccgaaaagaatgaggccccccaagatcaccccgagcagaatggccttggaaatgttcaccggtgccggcggttgggtgcagttggagctgtcggaagcatttcccgagagaaacaccatggtcccagccggggccgggcgaggtccggctgtccagggccacctcccgggctggcgcggaggcgggagcgcgggagccgggaatcaaaaggtctcggctggagggagccctgccaggtgggtttggctgggggtgagagcgcgcgcgcgggtgggaaacaaccctggccagccctgggaaccctcagaaggccacatgaaggggcagggcattaaagacatggccaggggcgcgcggggctgccggggaccctctccacctgccgggctggcctagcccgggacccggactccctccctacccgaagctgggtgcgaagatccaggagactccttgcaacatgcaattccagaattacgagaatctgcttttccgcgctgtcttattcgtcctggctgggggaagattcagcattctgcacatgattcggaattc

SEQ ID NO: 1424 - DNA, 95701 bp, Homo sapiens
cataaatgtcaaatgtggctgtcagtaggttgagcctgaaaataaaatcccctcacttccatcaagaaatagctccaaacttagagtgtgtgctcaaaatattcatgatgaaatcataatcctatatttatagtcttttggattgtgcatgaaattctgtttcccatggtggttttcgttgaagtgggcacagagtgaccaagaaagcattagctgcagggaaatgctgttccgtatcattctgaactggttggttgtgagacaccctccctcttccctgtgccctacccgctgcctgatgagttgggtctaccacccaccccattcccagcaggtcccctctttgattggtcctgtcttgtcctccaagaagagctggccttccgagaaggaagtggggtgggtacctaagattattcccctttcctctgcatctttcctgtcctagacttcctccccgttctcactgagggagatggtgtggaccttaatggttggaacttgatggttcttgtcaaggctgggggttgagggccctacacagcagcagacctgcaaaaagcttttacttctcacccgggctgtggtacaggaggattggtctttggacactgtaatcctggcagatccacggggcatggaagagaaaaatttccattcacaaacgccatccgtcttggagatcctgtagaaggtctctcttgatcccacggggatgcgcaccatgtccttgtgttgcccttccacggcctggctgggcgggtgcagggtgtagcccagggcatgtttggaagactgctttctgcagagacactggattctcaagacattctgaaaggcctttttgaactcttggctggagcatgggtatatgatggggttgatgcagctgtttagatatccgagccaaaatactattttaaaaactgtttcagagggcttgaaatcagggaagaaagaccctggaagaaaacacacagatttatacatattatttgaaagccagcaagccaattggctaggaaaacaatcaaacagacatctttctgtatttttaaacggttaaaatgatcccaaacacatatgagtttctcacatttgactgactagctcctatgactgtcacccttttgcaatatcttcaaagaccattcctacttggtccgcgtgtgtcattaattacaggagcaggcccagtgggtagggttgcactggctctcagtgaccaacagctgctgtgaagttttaccaaatgaaaatgtgaaactcagactgagtccacatatgtaaattgttttgcctaaattgaaaagtaagttggaatccatgcaagtaatccatattaaaattcggttatctgaacatgccctttattctctgatgcagtgttatgcaacagacacagcctcagtgtttatgaattcctcccctcccaaatgttagaattatggattttgatgagaatctcaactttacacaatattggccttgccaaagttgggccagtgattctcaatcacttttcctagatgatgtcttttgatgtcaccgttagctccctttgtcaatatccctcgatgtctcccaaatgtgtgtctttgcttcacattcggagtcctccacagcctctggtctaaccagctttctaatatgactagttgctattttttctctagccagactcactacactttttctccaggtcattgatcattttttttgtcctctcaagttgggccactgtgtccttgatgcccttttccaccttctctacctacccaaaccctacccgttgatgtgcacggcaggaaccaggcctcaggacccgtcacatcctgcgcagagactgccacagggcatttcgcagcagaagaacaaaactgtgaagtcttaaaatggaacaaccttaaggattatctcctccaattactcaatttacaaatttaaaaaatgcttatttagccttttcccagctgccgccaagatgctctgcccttctgagctgaggctgcgttggggtcaggccctcactgcatccagcactagcactactccgggcagcccagccttgcacttgtccacaccacggactccatctcagagctcgcctgcactgactcagccctcattctgtataacgctgaggggatcatcacataggataaggtcaatgtcgtttctaaagcagctggggtaaatgatgacggcttttggcctggcttgtctgccaaggccctggccatcgtcaacttcgggagcctcctctgcagtggaggggcggggtgggaagacctgctcagcagctggtggtgtacctgcgggaggtcctgcccttctgtcactgtggcctaggccgagaagaagaaggtggaagcaaagaaagaagaatctggagtctgatgataatatgggctttttttttttttttttgagtaaacctattttataacacgttcaataaaaagctgaactcttaaaaatgcttattaaagagattgtcacaaacctcatagctacaatactgataagagtgatggataaagggtatgggactcccaatccaatgttctttattctctgattctcagacttccaagggcttttgctaaaggagctttatgaattatgaaatcccaaacgtccctcttcactcctttcagagaaattgcaaaataacatcttgactttccttccacctcctttcttttctttcttggctcccaagctccttttccttctccgcgggcttttagtcacagcttcgtgtacagttggtagaatggctttgggaaactcctatgatgcctttgggcctccagttttcttatctgaaaaaggagtatgttgaatggatgattcctaatggccctgaacaatttttttgttgctgttgtttcaaacctaaggtcttgattttatgtctttcttttcctctctgctctgtggacctatcagagccgtgacaaattgctggtgctattaaaatccactctggcaaacagtgctctgaaattaagtcaaaaagctcatcaatataaacaaagagtaaacttaaatactgaagaacccaaagaagacacaatagtgtggttgttgatgggagcatttattacctctgaagcacactccctgctaagttccatgtgtctcaaattcacacacacacacacacacacacaatgggtgtttatttggaaaacatgtaaagtgagaaagttttattctttagctctaaagcttttcatgttgtcctataattataataaagtttacagtctttgaatgcctgatttgaaacaggcaaggcactgtgctgaacactttccatatgatttaatcatcgttagtaacatgaagagttatgtgactcttccctattttacaaatgaagaaactgtggcttaatgagtttgagtagctcaaccgaggtcactcacatagttactggtaggtttgaaattaggcagtgtgattgatttcagggcccatgctcctttgtggaatctccaaatatactgcaataatacatctcttaggaggatagctgatggggagtgataaagtgtgcagctgggggaagctgaattggaaaaatgctttttcgaacctcatctgtgatggaaaaaatggctaatgccaacatgactgatggttttgtgcaaatgcggtcagttccagaaaaaaatttgtcttacattatgaaacctatatattgtccaatatttcctactaatagtgacagtgatgtgattaaggaaacccatttcacaaagacctgcctgggcctgtgcttaatgactacaagaatgtctgagctgagcacactgaaacccaccttgtctgggaatgtcactactctgtaaatcagcgagggaggggagggtcgtttccttatttgaagaatttcaatttttaaaaaagaaaaaaaaatatgcactatgaatgtgaatgctaataaatatggtttgagagtcttggaatttcccataattccttcaattacactcattctgcttacagaacccagttttgcactcgtaaatctcaacatttccttttagtcacttccttcccatcccttctttccttgcgtggccctgctcttaattccaggtatggctgacccagagccaagctcttgggccctctctctagtctcttgctgtgttccagtcttcacaggtgaatcctggcctccccctctctgtaccccactcaaaacactcatttcttcaacatggctcaggtataggtatagggtgagaaagagagttgattaaaactaatttacactaagatctgaatgtcagataatctctaggcctaaccccaggaatattttctttttaatccaagcaaatctctagattttggcttatgcttccagaccagagaccttcctgtaaatgacaatgtttggtttatcctattaagtgtgtgacagcagccagatgtgtgtaagcctagcacggatttgcatgctcccaaactgatagttccaccaggggcaggttgcaggatccattctcatgcttggagtattcttcccttgtgatggggaacaggtgctgggagccatgtgattttctttgagcagctgctgactggctggggttagatgagagactcatagctatgcttccttcaagaactttccaaagagtgagaaaagacagcaaaagggctaggcatggtggctcacgcctgtaatcactgcactttgggaggccaaggtgggcagatcacttgacaccaggagtttgagaccagcctgggcaacatggtgaaaccccatctttactaaaaatacaaaaattagctgggtgtggtggcatgtgcctgtagttccagttactcaggaggctgaggtaggaggattgcttgagcccgggaggtagaagttgtagtgagctaatgcgcaccactgcagtccagcatgggcaacgggagtgaacccctgtctaaaaaaaaaaaaaaaggacagcaaaagaactgctcctctccttattgacattattcccatccacgtatttcttcctttatttttcctctcctagaaaggagagatggggctggaattgggcttggaaagcagctgcatggccccaaaccctcctcctgctctctctttctctgcccaaaccttccccgtctggttctattttctctgaactctgcattagttctatcctcagcctccattcttcccaaatctctttcttcctgaggactggctatgtttttagggtgggaagacagctggagaatgcttgttcctggcctccagccatcaggacctagagggtcagggctgaaccagcctggttcaggggtgggtgcctctgacccagtcactctgtggggaagtccattcgagcagccatccggccggctttgctcactcacggagctccagaatccagtaaaatgctagagtcttgaaggcattctcctagtttttgctgcatgaatggccgaccttctgacagacggatggactgactgactgaatgaatgaatggctgtgtctctgtgttcttgccatggttcttcttcacagtgtggcttggttttcttttctgcgtgatggctgtagcctcatattatctcccaaccctgacttctttctgctgtctcattcttcttttttttgcccaccatttcagttcagtcatttggtttttttgtaatgttattttactaccattttttccttgctctatcatctggcatcagaccctctagtttttctcatgatgcttcataggaagagccagacttccaaatcacccacatgagaataggggctcctacttctttggtcaccgtagctatggttttctcctcaacaatctctgcttcaagaagagccaacagctcctgacttaatcccctgaacaccttgccctgcagctcaagccatcctttgcatgtgaatttgcctggtttaattcttgggctttggaaaatccccacagcctaaggattcttcctgtcactgagtttctttccaccatttggtctgctgcagaatttctgcctctttcctgaccctctggacaccctgaccaacttacgccggtcagactgaggtggatagaacaggagtttatggccaaacaccatcaacattctcattcatggagattcagaatcctcacttccactgtaaaggcctctagatgccaagaagaaattgaaacgaataatttaaaatgttgcctctatgtctttccactgaatgctatatccattgggaaaatctgacttcatttttgaactggggctcatctaataggcttatgagggggcactaggaggcatcccagtaaaggcttggcgactagagtcaccttttacagttataaaattacagcaacatttgcctcaatggctccaatacaagataaaaccattttttcctgcccatgctggtctcctccatgaatttgatacaccggtgagtgctatggttagcttcaaaagttggtgagagtaggaactgagttctcgaattcctatccagcactggtcattagggggttcctccttagttcaactgtttctctcagaatgagggtgacttgatatggaagctgaaagctgtgagtcagtcttcttggttccagcctccagcttctgcgcttcattttaccccctggaaaacttgacatcttaatgacaaccttgagagacactgggctatggtaaaccctacttagctggagttgcataaggctaaaatgtgaagactggcaggcacttagagatcagagctgtcaacctgtcctttatatgtgaagacagcaaggctgaagacgcgagtagttcccccaaatcacacagctggacccaaactcggctccacctcacccatttccactcctgatctttgtgtgccgtttagcaaccctacgatgacatggaagtgttaatggcagtatgtccagctttcactgaatgacaacaggttttgcagagataaggagaaagaagagaggggagtagtatcctcaataattgcattattttaaaagtcagagtgtgctgttcagaagggtttgtcagcagggccttacattctgagaaatgaagtttgaatgatctcaatttaaaaaaatgtggactccaaagaagaagctaatgttacatgaccatgggagaaaataatctttaattgtttctccttgttcagcgagtggtctctccgatgtgcctggtacacatccaatgagcagaggagagagacaggctgccacaccaacaggccaaggagctccagtgccagtaacattcaggccagacccaatggctccttcttaccaggaagaaaactgccccatcaaattaaaccccagagacaagctatagagtcaaagtttaagagcagaccagagtctaccagatgcctttgtgctgaactactttggcctgaaccctcctggggtttatgtggggccacttgggcagctctcagtcagcaagaagtttttagattatctaccttagatggtgaccagggctctctaagaaggtggtcagaataaccatggacagtaaccttaggcttgcaacctcaggttcacagacagacttcccatgactgacatgaaatgtgtatgtccagagatacattttcctgggaagagtccttagcttgtattagcttctcgcagtgctctctggtgatggtaaagatggttcagcctggatcccaggtagagaggacaagctgtaccctggctggggaacctcacttagcctgtatgtcctaatgatagaatctagcttaccaacagagcaagcagatgtgatttcggtgcctctttggaaggacttcgctagtctttttttcccctatttaactggggcctgaaattgtacagctctccattcatgtatctgagtaaagtcatgtgtatgctcacttgagagtgttggcatgtggagtcttttctgaactttctggcagaaaacttgagtggttggtaaagtgaggaaggtggcactgagcaggaatggaattagctctcctcttgcatggggcaaagcatgggagcatggcatgggagggtacagtgagtaaggggaaccgggcacactgtgctgggcacacatccccgaaggagacaggctcagggcaccctgggggcctgcccagtgtgggatggaagtgctgcccacttttccagggactgaggcacgttggtctatggttactgtgaaaaaccattgctccttccaatccaggcaaggaaagaggtcacttggggagatgtcctctcatccctcaaacttctgcaagtggcagctaaagttctcttgacaggatctgtctggctggccaaggagagctctgaggaatcaggaatttcatcctggatgagtctgagctgctggaattaaaacttgtcaaatggttcgtctcaccagttaacaaagcctaagaagcatttctccttttaggaaaaaggagcaggtccacccaaatgcatgatttggaccccaacgcccataagaacgctggaaagagtaataggggaccccacatgtagacatttctccctagaagacctccttgtgtccaataaataatttgatttgaaacactctcagaagatagcaagattctctaccccactccctttatttaaaagattatttgttcaggaaaaagctagcaataaggaagtcatcatgtgcttttatgggctgcttccttaaaagcagatctcctttcataagccagtgtattttccaagccttgtcaattttactaaggtcaccattgtttcatgagtcttccatttaaaacatttttataatataataaccaaaccaaatgtccaacaatgatagactggattgagaaaatgtggcacatatacactgtggaatactatgcagccataaaaaaggatgagttcatgtcctttgtagggacatggatgaagctggaaaccatcattctcagcaaactatcgcaaggacaaaaaaccaaacaccgcatgttctcactcataagtgggaattgaacaatgactatacttggacacaggaaggggaacatcacacactggggcctgttgtggggtggggggaggggggaaggatagcattaggagatatacctaatgtaaatgacgagttaatgggtgcagcacaccaacatggcacatgtatacatatgtaacaaacctgcatgttctgcacatgtaccctagaacttaaagtataataaaaaaaatatatatatatataaatttttttaattgtctctgcacaaaatctctccctgagaccacccagtctaaagaagagtaatcttcaaactcacacctgctgaatggcttatttatttcacggtacatatcacagtttttaagttttcttatttacttgttttctttgattgtctcatcctccagagcacagatgatatgctttccaatggtaggagaccaggttatctctctcactgtagtgcaagatgggagcaggaacccaattaacagttcctgccagaagaatatgtatctagttccttctcccttttttttgcctcttacattccaactggtcaccaaaccccacaggtgtctttccttgaaacaccttccaaattttccttctccatcacctccaaccccagcactgctgcatggtgaactggttgtttaaagctgggtgagtcattttttccttcttgggcctcagtttcctcatctgtaaaagtaaagacttagaacagtaattgatgctaccccttcctatctgtaagagcagatgcttctaggcaaatggaaacagtcaaaaggggaaaacagcccatgacaagcaggatgatgaaggaacgtggtggagagatggccagaagggaagagggcaggctttggaaggaagaggggaaactgaggttttggggaaggctttgggaggacaccctcatgtctatcctagaggtttactttgagatcacggaaaggaggggtgggaggagaattcaaaggctgctgtcatgcagtgcgtctgcataggggcccaggcaattctgattgcatgaagcgggaatggaattagctctattcctgcttggagcacagcacggtttgggctgctggtcgcgtcagaacttgtgagcttcttaataatacacgggccacacacctccacatctgaggcctgggaggctaaggctgtgctcatctggtcctttccaaggagataggatggaaagggaagaaaccatgggggaaaattcccagaaataactaaagggaggggaggcttatcaaggggctcagtattgtagctaagggaacctcataatggggtatctgccaagacatgtgttatgcattatctttttgttgctgataagatcaagtccaagctcctcactctgtcattcaaggcccctttattatttggttccaccagccctacacaaccttcttcattcctcattcacttaacacataatttacttagcacctgctcaggccaggcacttccatagatactggaggtagaatggtcaggaacatgcaaaggtgtttaccttctatgagtgtctccaacaaatgcctatgttggaggcatttgttgttccaacaaaggaattatgagtttccaacaccaaggctttcttcctgccgcagtagacttttcactctaactttgttagttcacgaggtgactgtgacctcagctcctgtggctgttttctgctgcactcttctgctcttcactcagtgacctctctcccctgtatctactcaaacttgaatttgtccaattctctctgtcttcaaggctgttttcaaaatcccactcatccacgagcccttctttgttacagtatagcttgctttcttgccatttcccctgtggatttagcaccagtttcttttctttatagcagggaaacccctgggccacagaccagtaccagtctgtggcctgttagaaaccaggctgtatggcaggaggtgtgtggtgggccagtgaagcttcatctgtatttaaaatttacagcctctctccattgctcacattacctgtcagatcagcagtggcattagattccaataggagcaccaaccctatcgtgaactgcacatgtcagggatctgggttctgtgctccttatgagaatctaatgcctgatgatctgttgctgtctccatcacccccagatgggactgcctagttgcaggaaaacaagctcagggctcccactgattctacattatggtgagttgtataattatttcattatatattacaatgtaataagaatagaaataaagtgcacaataaatgcaatgcgcttgaatcatcctgaaaccatcctcccatctccaggcccatgaaaaatttgtctgccatgaaaccagtcccttgtgccaaaaagattggggaacactgctctatagcccttatcaccattttctgtgctttacttatttctatttttggttgcttttcttgactataaactcccttgaaggaagagcttcctgtctttttaatttactgctgtatcctcaacactcataatggtgtacagcatttagtaggctcccaacaatattgctgaatgaatgacacattcaatcctcctggttttagtctccttaaagatacaccctccttcttatccttcattcgtgtctctctaagtgatcaacatgattctcaatgaatgcttttgagccaatagatgacattggttgatggaagaaaacaacattttgaacacagctcctgcttcaattactcacagctggagatagattctcaaatgcagaaacagagcctgtcttaactcacattccaaggagatctttcagatcttcaagacactcacatttatgtgaaaacaagaccattctccaagtagttttatacagctaagttgcaggcacttcataaaatgattacttccagtacttataaaaacattttatagggtcctggaagaagggttgaagcctataattcagatgtgatagtcatcatctcctctcatatttgtgggattcaagtccaaggccaaacaccacacatctgaagcagtgacacaaacaaccaaaactgatctcccaaggaggaagtgtgaggctttttcaggactgtgtcccttcatattcagcttaaaggctaaagcaggtttaggtcctgatccttgccagaaaggacacaggtgagttggctgatgcttgaatagtcacaggtgaacaggggagcaggaaaatgggtttttgcttccggactgctgcaaagatgcttaatctgagtgctctggacagttccgggtcctctcccaggccactggctcacccagaggcatggcccttgcatcttccaacagcatcttctagctttgtgcgaagcaggaatatgaataaacccttgctcttcactcccagctcctgtgcagctccctcccctgcctggattaagctagggatgaagattggctataggtctctgctctttctccccagccacttgggtaaacagtcctaggctccatctggactagaacacctgaccagggcctgacctctatcagtcatgggtcctgtattcaaatggacataatacatatatataggaattttaatagctcatttaaaacatgcaggatgtctttttggaagctataatatggcttctaagtatagctgggcagaccaaattttaacacgcagaaagggattggggcaatttcctctttaattttaaaaggcaatagagtatggtactgttttgattatagacatttttgaaaataggaattggccatgccttcctctttcatataaatgtcacatttagaaatctcagctttgcttgcaagagacatccttgctcttttcaaacttaatgaagccttctgcattctcatctgagaactggctggtactttcagggggaagatcaaggtcagggcagctcattcatttcatacctttagtttctttcttttccctatgacttgcaaatctctatgcctagaccatctctgccacctgagctccgtcctgcacacacaactattaccagacatccctcctgatgtttccaaactatctcatccttaacatcatcaaactgaattcaccatctctcacaaaaccgactcttgcttctctgcttcactttgggcagccttcctctcacttgtccaagccagaaacccactgtcatcctcaaccgtccactctccaacctcttccacaacatccaatcacccagccctgactacgaaacctgtattcacttgttattgtccattccagttctggccaccaccacgtctagctagaacctcatatcagttttctaactgggcttcctgcttctggtcttatctgcttccaacccatttctcacactcttgccagagagattctgagaaagcaaacatgacactatccctcccttgagtaagtcatttcaatgattctttactgaattaaagatgaagtatgagttatatatgaaaacttattaggcccgggagactgaaaattcacttggctggataagtaggtagtagagcatggtaatccaagtgcccacccagagactctagtcagtgtcatagaagagcagagaattacatcctccaggatgtgatcatttgcgtgactgttaactcagctgagcgatgtggcatcttttgttcactaggatgtaggttagggttatagtggttgagatatcagaatttaattttaagaaataaatatacgtctcctataaggcagtgtgtccactaaaaaactcttccgaaggccaaagaatattcagaatgagtttccaactgttccagagatagtggtgacaatgattcagaaagttttgtaaaacctggaagacccaagacaggcataaaaatacctgaaggatcaacatgggaagtggtaaaaataccatttgacatagcaatcccattactgggtatatatccaaaggaatataaatcattctatttcaaagatacatgcgtgtgtatgttcattgcagcactattcacaatgtcaaagacatggaatcaacccaaatgcccatcaatgatagactggataaagaaaatgtggtacatatataccattgaatactatgcagccataaaaaggaatgagatcatgtcctttgcagggacatggttggagttggaacctgttatcatcagcaaactaacgcaggaacagaaaaccagacaccacatgttctcacttataagtgggagctgaatgaacacagggacacaatggggggaacaacatacactggggcctgtttggggggtgtggtgaatgagagcatcaagaagaatagctaatggatgctgggctcaatacttaagtgatgggttgatctgtgcagcaaaccaccatggcacaagtttacctatgtaacaaatctgcacatcctgcaacatgtaccccggaacttaaaataaaagttgaagaaaaatagtcaaacaaagaaacaagtgcatttgaggctgtctcagaaggactaatccctggtacccgttgtgattttctgtgacctcacaccagccatgtttctaagaaaaagtcgtttcccgctgtcgggattcccctctgaaatgctcacccaatatctgctccaattaggtgattaattcagaacatatcagatcaccaccaataatagtttctggatgtgctgttagagaacaatagtgttggtcagcaatctcagcacagatgtactaattccccaggtgggtgtggaagcagtaaaacttttactcaactgtagttatcaatttctctctctctcactcacagaaaaatgttcatgagaagaaaagaaagctgacacagttcgtcaaaatgaaaataatgagactcactattgttgtttattcagatttgattttggagagttagaagagtttctatctcaagataggaattggtgttagcaagtgactgccttcagaatgtgttagaacctggggatctggcatgactctattttcctaagtttttcataaggcttatactatctaagaataactaaagaagaaggctgctagggagaccaaccaggaggctagcatattggtttggggtcagagctctaaccgatggctgaaagctataggaagactgatttgggctgccctggaacttggctttaccatcaatgatacatgaaaagtatctcagaataggcgggatacccactcactgaggccagagactggggagttaagtaccacacagcatcctattaaaatactctttaggggacatttaaatcctgaaattttacaacttattgagaaagcaaaaattattggtggagagaaagttgattgttttttgaatgttgaatgaatgaatgttgaatgaatgaaaaaattgaatgtcttgcttcccttttaatattgcaataaggtgtacattagaagcattttaaggggcatatatatataagaatatggatatattattggacatgacaacttatttagcatgatttatctgtttctgagaatgagactagtctatatgtatttcaataactcctaaattttctccatttagcattcattacacacattttgatctaatttgttgttgaagccatttataatcacctcatataaacacttaaggcaacaagagctgagctgacgtctggactacaaatacgcaaggatgtcaacattcagaaaagatcaggaacttgctcagggttacacagccagtgagcaaaacgactaggttaaaaactctgttcttcagatttccagtttagaaatctttcttttaattgacacattgatttttttttcaattgcaagagtagaaatatcctccaattatttgggggctctcagaaaccctactctaaaaaaacatgaatacattcaagctgagtatctgcagctagcattcagccatcaagcgagtggcttcagtccttgcttatttcagctcatgattcatacatgcctcttcatgtaaatgtctcacagaaacctcagggttaatgtgttcaaaatgacacatgctagtctgcttgattctggcatttcccatctttataaattatatttggtattcactcactgttaagaaaaagtgacaatcagtcctgatgtcttcttgacgtcttcagtagatcagaactcctagtattgccccagtctttccacgtctctccatctccattgtcaggccctactcagccacaacacctgtcacctgtaagtgccttcttgttgatctcctgcatgcctgggtcaccttcccttttccctaggatgacctttatggaatacaactctaattcggtgacatttccacttaaaggcctcaaacactttccagtactcttagatgaagcccaacgtccatagcatgggccatagggccatatgatctgctcttgccttccgctcctggcctgcctttcactctcttccctatcccctgctctggccaccctgacctcttttttatttttatttttaaattttttttttttgagataaggtctcactctctcacccaggctggagtgtagtggcgcagtcttggctcactgcaaccttcgcctcccaggctcaagcaattctcctgcctcagcctcccgagtagctgggattacaggtgcacgctactatagcccagttaatttttgtatttttagtagagacagggtttcaccatgttgaataataagactcattattgcaagagatgtactccattgagtacatctcctgacctcaaatgatccacgtgcctcagcctcagcctcccaaagtgctgggattacacaacctgatctcttgatctatggaatacttctctgcaccaggcccttcacttctgctcttctccttgcatggagtgtcctctcaacctctgtcccctccactcaccatttatatcttagcttaaatcacccttcctcaggggaaagatctttgatccccttccacccatccatatacctcagactccatgctgggttgggggggggggtctctcattaaatgttatcaaagcatcctaaactttttcttcatagctcaagcaattgttcttatttgattatgtgggtgatgatttgttcaacatatctccctatgtaaatttcataaagataggatttgtgcctggtacattgtagttgttaaataagtattcgttcatggataaaatatttatagagcactcattatgtggcagacatcatgcaaaatattacacaaacattatcccatttaattctcccaagaacatgatgtgactgtattaccaacctcatcttacagatgaggaaactgaggcttaaggagtttaatttgcaactaaggaaaatagctgagctcagattcaaattcaggcttcatgcccaaactcatgttttaaatttctagatgatgctatctgcgaatctgtcactgctttgctggctttatagtgaaaatagtgcacagagccatagtacttgaagttcaaaacaaagacaatcatcagaatagccaagaaaattaatcacacattccatgtcctattttttcagaaagcagagacatgtgtaattcaaattattaatacaaaaataaaattctcgaatgttaataattaggtttgttcagaatagacatgtttggacatggaaaaaaaacccacacatactatattctgtctgaaaagactttgacaaaatgcaactaataaagtacgcctaaaaaacaatcaggtaagattggtcagaaagtatgatctgttatgtatgacaaaatctgggtgaaagtgtaggaataaaaggagaactgtcatctgtagttcttggatatggagagaagggaaaagtgaaggagagatgataacagaaatagttaccatctcgtgtgctgcataaaaatatcaatgcctgacacagacttcttagttcttagtacttgttccccagggaggaaatcccgacagctcacttggtagttcagggatgagggcaagattgttcccttttctgtgcctcagtttcctggcacacgtaagttcagtgtctggctgtaagcatttgctcatttgctatcccagagctatgatcagtttccttcctctgcatgtagcagctctgcatctactttcagggtatcttctcagtcattagtgctatcttgtctatttttttttttttaacatttggggataatttccaaggtcagaaaccggacattgagtacatcttcctgcagagatgcccctggatgtgtggttctggtttacacaatggttacccagatgccacacctgtcagctgctctgagaatccccaagtatttcaagagaatttctcttattcagagtgctggggaaaagacatattcacagagaaatgtgctcacatttcttgcatagcctgttgtccaatattacctaattgtggctacagaaagataaggtataattttatttatttgggatttttttcaaggctaagttgaatctaatcaggtaaataataggtgtgtttctacaagttgtgctaagtctactctagagctgaggccatatgtttattacataggatttcttgctggaatttcttccatggatacctgggctttctatcacatctggcactttgtttcttctttttgtcacttttagagaaaaagcctcccagaaattagacataatttttgaaaaagagttagagaagtttttaagtttcatgatctcataacccatgtggagagttcttcctagcaccatgagggtgatgatggtggcactaataatagtaattataacagtagatgtaatttattagtaatttcaactgtccagcaatgtgctaagtacttttcatgcaccacctcatctcctcatatcaaccatgtaaggtaggcattgtttatccccattttacaaatgaggaaaatgagactcggggagtttaataatttgccaaaaaacaatcagccaataagagtgaagctgggttcaaacccatgcttgcctggctccagaccctgtcctgtacctgctaacaccgaatgcgctacaacccactgcctggtttctctactgctgtatagtgctgtgtgcttattgccaaattttcactggcaaaatcagatcctgatttagacaacaaaacaaagcaatttgaatcaattattaagaaattttatggttaaaaatatatatttttaaaattttactttaagttctgggatacatgtgcggaacgtgcacatttgttacacagacatacatgtgcaatggtggcctgctgcatgcaccaacacgtcatccaggttccaagccccacatgcattagacctatgtcttaatgcccccattccccttttccccccacccctgacaggcctccaggtgtgatgttcccctaaattgtttttaaaaagggtaaaattcatatggaaccacaaaagaccccaaatggccaaagcaatcctgagcaaaaagaacaaagctagaggcaacacactacatgccttcaaaatatgttgtgaagctacagtgatcaaaacagcatggtactgatgtaaaaatagacacatagaccaatggaatagaatagagaatccagaaatcaatccatgcatttgcagctaactgattttcaacaaagctgccaagaacatacagtggggcaaggatagtatttttgataaatggtgctgggaaaattggatatccatatgcagaagaatgaaacttctaaactcctatctctccccttatataaaaattcaccaaaacagtttcaaaacttaaatgtaagaccaaaaactataaatatactagaagaaaatataagggaaatgcttcaggacattggtctgggaaaaatttaataaacaagacctcaaaagcacaggaaacaaaagcaaaaatagacaaacgggattatatcaaactaaaaaccttctgcacagcaaaggaaacaagctatgcatctgacaacagattaatatccagaatataaacggaatttaaactattaaacagtgaaaaatgtgataatccaattaaaaagggaaaataatctgaacagatatttctcaaaagaagacatacaaatggctaaccaatatataaaaatatcacgaatcatcaggtatatgcaaatccaaaccacaatgagatatcttcttaccccagtaaaaatgtcttcatcaaaaagaaaaaacataacaaatgctggtgaggatgggaagaaaagggaactattatacactgttggtgggaatgtaaactagtacagccattgtaaagaacattatggtggttcctcaaaaaaccaaatacaagtagaactaccatgatccagcaatccagctactgggtatatagccaaaggaaaggaaatcagtacctttaagggatctctgcacttctgtgtttattgcaatgctattcacgatagccaatatatggaatcaacctaagtatttatcaaaagatgaatggataacagaaatgtggtatatatacacaatagaatactactcagccctaaaaaagaatgaaattctgtcatttgtggcaacatggatgagcctggaggacactgtgttaggtgaaataagccaggaacagaaagataaataccacatgttctcactcatatgcagaagctaaaaaagttggtctcgtagaagcagagattagaatagtggttactgaaggctgggaagaatcgtggggagggggatagggagagattgggtaaaggatacaaaattacagctagataggaggaataagttctagtgttctatagcactataagatgactatagttaaaaagttgtgatatattgttggatggctagaacagtttgaatgtttccaacacaaagaaatgatcttataaatgtttgaagtgatggatatgttaatcactctaatttgaccactatacattatatatatcaaaacatcactatgtgccccataaatataatatgtatggttattttgtgtcaattaaagaaataaaataaaaataaattgttaaaaacttcctaacatagaaattatagtgactttctctttggaataagtttgatctatattcaggcaccaaaacagtttgaagaaggtcatagcaaccatgtttaaaaattactgtgtcttttaagatacaaaattaatatatgctaaatttttacaatctgtggtatccacaattggtatgcctcccatgcacatataggtgcatgtgtacacacacatacacacactcacacacacacaatacaaaaatcaaccatgatgctacaatctagaaataagaccagattttaaacaactatgattgtatttagagcacatgctttttaccagcctttatgtaatatgtcatgaacattttgctattttatttttattatagaacacaatttttcatggcatcttagtatttcattgcatgaatataacaaaatttatctacttctgctaatttgaatattttggttatttccagtttcctctattataaataactatgaaataaatatttgtgtggatagatttggagtattttcttaagttacatttctagagaaagaattctgggtcatataatataaatttcataaggtttttgatccgtattgccaaattgctctctggagaggctatacctacttatacttatccagcagtgaaaagtaatgacagtatggcgatgatgatggcagtaaattatgagtgcccactgggtgctaaactcctagagcttcacatgcagcagctgatctaattttcccatgtgttcagtgaggttgggtgccacgaagcctgttttatataggcaggttttatctgcataggaactaagaaagacattcttgccaaagactacaagggtctgcctgacctggcctctgccatttggtaagaaaacatttaacagccatgccaaagtgctttttacttcttaaactgcccagattttcctaacaaagcttttgtattcattcatgttccctcttcttgagatgttcttcccttgggtttgcaggtctagacctttctcttttatgtctcagctcagaggctgttcagtgaggctgggtgccacaaagatgcattttctaaacatgtaatctaaaggatacttctgtccctacttcccaatatccctaacaccagcctccctatcacatcagcccactgtatttctttaatggctcttgtccttttctgaaacatttaaaaattgtctgtttcacttatgaaatgtaatttccctaaggacaaggagcactagaatggaggctggtaaacagtaggaatacaatacatgcttgctggctgatgaataaatgcccatatgaaaggaaagctacaaagcagccatcaggattggaacccaagtgcgcttttgaatcttgctttaatcattgcaatctacagaggatgtctcctatcccaccctcagcagcagtatgtatttatttgctctttgccaatttgataggtaaaatatgatatattttaatattttattagttatttgtatttctgcttttgttaattacctctgcccattttttccattagttagtcatcttttctcattttttgtatttatcaatatttgtattagacctctaaatatatccttgccaggtaagaaaacaggtagaaaagaagaatacatgattaatttgatagatgtagaaagacattaagtagaattcatcaccaattctggataaaatcattttaatgcatatagactggaaggacattctcttagtagcacaaagaagacctgtaagttccatcacaatatttcacaaagaactaccaaaaacatagacatttaactcagtactttctcactcatgctttgccttaggttctttatgtagtaaatgtttactttgtaagcatcaaatgaattaatgtagacaggaatatatagatcagtgtctggcacatagtaaggtcatatacgttggtgattattgttattaccactatataacataaacaagtaaaataatgagtttgtaaccattcattaattattgcttacatttttagtacatccatgctcaccctttcatgagtaaaattaagtatgaacatgttcaaatatgtgaattacaaaaataaatgtaaatggattaaagtgctgtgttaaaaaataaagcctctcacactgaattaagaaaaaaattgaatatatactgttatgaaagacacaaaagacatggttacaaaaataatatggtttggaaatatatactaagcctaggtaaaaaaaataaactgagacggtaatattagtattaaacaaagcagactccatgacataaagcatttcatggaatagacaggattattttaggttgataaaagtcatgcttaccaatagagccatatttattaaattttatgtaccaagagatagcaaatacataggtatatgtatgtatatttttaaaatgcttaaaaattgataaaattttacttgaagtagatgactaagatacagacaacaaaatatgtatcaagttttcagtttaagagtaaatcaatgacaacttagaaaatactgaaaatgagagcttcatgcaagaagccaaagttattctcctctgtgaagtcttagatggttatatttaaacaagaaagacacaaatagcttaatttgggcattagagtaaataagttggaaaagaactacaaattaaaacaaaggaagcaaaaattaatgaattaaaaagcagaaaatcattagaattaattagtacatttaagctgattcattgaaaagactttaaactggacatgcctctgacaagcctgactagaaagtaagaggaagagtataattgtccatcagtaataagaaataatatattttcagatgctgaaaaaagtgaaagcaatttcaagtaaaaaaccgtatgcagataacatgaagaattttgataaatttgaagatatttgtctaattttattcaaggagaaataatatatgaaaactataatgattatagaagacacaaaaattgacaaaatttatccttagaaactgttggatccaaataatttatattcatgctatataagtattttcagagtctttaagtatgtaaaaatgcttcctaattcactttcaaagctagcataatcttgatctcaaaactgagaaatagagccaaatcaaaagaaaacaaataaaaagtaaatatgaacaacccactgtcaccacaaaacaaacaatcccacagacttgtatcatttagaaatgaagttgaaatacaatgaaagttgtcgattatatctaccagtctattaagtaaaaacaaaccatgatcaagtagggcaggaagtggcaaactttttaagttttattattaaaaacattagggaataatggaataattaacaggaagggaacactttcatttcaaggattgaagttgttacctgaggtggctctttttgtattcagtgatacaccattagattctgcatcattttcatgcaactttatctgtctcttcattgttgtcagaataaattaagagaaaaagtgaaatttaggaggaaagaagcctgctatctctggtaatagatagtctgtgtggttcttctggcctcagaattgtggttcatgaatcttgcatgaattttgggatacagggccagatagtaaatattttaggccttgctagctgtatggtctctgtttctattattcagttctgccactgtagcttgaatgcaaccatagtcattaggtaaatgaatgtgtgtgactgtgttttaacaaaactttatttgtgaacactaaaatttgaatttcatataattttcctgtgtcacaaaataaattctttgtttgattgttaaaaattatttaaaaatgaaaaaattgtatttaattcatgtggccataccaaaaaaaaggaggcaggttggatttgacctatgagctctagttagctaacatctaaggtaggatttatccctcactttaaagggaattaagaacaaaagtgtttcttctgccctttgattattaagaatattattatgaacaagaaagagatgtctaaaattacaattaatgaacaatgttctagaagattaagtcaatttaatgagagaagaaaagaaagcagatataaataatggaaaaggcaacttattaagatgtgtatcctgtgtactataataatttgttacctggaaaacaaacgttgtattttttaaaaaatcttttttcctaactttgaattctaaaaaaactaagaaacaatgatcagggcagttgcaatgaatattccattagattgtgtccttcaaacaccatctcctactaaaaaggaccaagacttcctggagaaatggctgattccaggtctggccaggaaacatacaagaacagacttattgctactggtcaggtggccacaagagactgcagtatcgtgtcaaaagagctaaggaactaacttaaatgaacaaccattggccaatgatgagacaatgtgagactcgataagcattcacaaaggattaaaaatcgctgcaaggattaataatgagtttcaattagtaaaatctcgatgctgggggaaaataaacctttatttattacctttgaaggaaactaataactgccttattattttgaaaactgataagtaaagaaccaggcgtttatcccacctttcttgtaaaatctacacctcagttaatcaaatggttgatgagcagaagttgctccatctatgtgttttcaaactaataaatgaaagtggaatgatagaatatcgccactttgcaaccctaaaaataaaacaaattaataaatttaggcaattactataattagcaatattttgaaaaaaacaataaaacattttttacctcctgatggaagtatataccatctaagcattagttttaccacaaacaaacagacaaagtgatacatccttctaagtctaatagccaacttgcaggaaccataaggaggagaatatattaaatgacaccactgtgatgaagtcagcaaaattcaggctacggaaaattgtttattcaaaggaaaattaaatagaaattccaagaaaaagaaagcgtaagggagaacttgtacaggaaataaacttagacttataaaccattcatactatatggacctgatttggatctcaattcaaataaaaaagttctaaaagtgtcctaagaaaattgaagatatatgataatataaaattattgtcagcttttgtttagatataatagtattattgttatacatttcaaaaaaagagtaatgtttagaagtaaatagtaaaatatttacagatgaaatgacatgctctctagaatttgcttccaaagaacctgagtggagtgagaaatctgaataaaataaaactgcctatgaattagtttacaattattaaaattgggttataggtacatcagcttcattacatgattgtctctacttttgtatgcatttgataatatccataataaatacttaaaatattaaaaaagaataaaagcacataactaaaaaataactcactgattacctacaacatttcgctaccttcatctgcatttccaagtttttttaaatagctttcataaataagtttgctttttaattcatcctgcttgaaagccaaatgcattcagggctgtgaaggacacaaagaggtgggattttgttcccagcctcctggattcattatgaatgaacaaagactggtagaaatcctatggtaattcacagcctacagtaccgtgaagacaaggaggaaagattcgaggacaaatgtatcctacacgtggccgcagagaacagacaccatggggacatatgagacagtggagtggagggtattttaaatgaaggggaatgatgctaaaggagggtcagtgtaaaagtggatagagagatgattaatttcgaaaggggggtacaagatgaagggacacccctgaaatcgggcacaggcacatagatttgataccatgattatcaggcagcctctgtaatgtgtgaccacaggaagcttttgcatatggctttgttttaaaggcagatatgttcaggacatattggagaggtttattccctcactgcgcaaatttttatagagatgagactggaattgagagtgaaatgaagggagtcgtattagagcatgagttctctcagcgttctcctccaaagggtctgcaaggtgaacaatatgttcacaacgatactaaggcagtatttgcctttgccactatcattctgttgtgagagtggagtgaaatgtttcagagatgaaatgatgtgtgttattgtaacagattaaatgaagagcagatatgaggatttagctatcatttatagcctgacatcaaagacacttgcaaaaatgtagaacaatattaccccctcactgttttaaatttggaaaatccagtttgttttaacaaaagtatgttatttatgttaatatgtaatgggtttattatttttattttattttattttatttatatttaaaacagcgtctcgctctgtcgcccaggctggaatgcagtggtgcgatcacagttcacggtagccttcaactcctgggcttaagcaatccccctgacttagcctcctgaatagctgggactataggcatgagccaccatgcctggctaattttttgattttttttgtgaagatggggtctcattatgttgcctaggctgggcacaaactcctgaactcaagtgatcctccagcgttggcgtcccaaagtgctgagattacaggtgtgagccatcatgcctgacctattattgttattttaaagaaattaatatattttttaaatttctcagttttaattttgaatattgtaaatatcaacagagtctacatacacaaaaactctttaatgtcctatataattttaagagtgtagaggggtcttaagaccaacaggtctgggaattcctacatttgagtgtttattgaggctatggagaagggggattcaagaggaattgcaaaggaaaagtgatcatgacatggtgtttacgtcagtacataattgttaagtgctcataaagtccaaggtcttaaacatgaagtagaaggacacaaggtgtcttcaggtggtcaaggtggaggtctgtttgattcagatacaaattctcatctgcatcgacagtaagttagtcttttttttttgggatggaatctcacttgtcacccaggctggagttcagtggcaccatctctgctcactgcaacctccgcctcccaggctcaagtgattctcctgcctcagcctcctgagtagctgggattacaggtgcttgccaccacacctatctactttttgtatttttagtagagacagggttttgccatgttggcaaggctggtcttgaactcctgacctcaagtgatcctcccacctcagcctgccaaagtgctgggattacaagtgtgagccactgtacctggctagtcttgaataacttctagtgatgttccaagtgatttgctctttcagagaattagatgggcgagattctaaatctcactcagaaaagcatggcttttttaacccataaagaaaaaatgctttctcaaaaggactcaatatgttaagcagatccgaatatacttatccctttgcttacacaagtcataaactgtgtcagctctcacctacctcctgcttattctcatttacttttgttcaaaggacatttttttattcctaaattatttccccagacagagatgataattcagtatcttgatgttcatttaatgcatgtgcatgggaagccaagtcatttgactatcaggagtctagtgaaaaatagaactagaatggtatctgcctgtgaaaaagacacaaagtttagagaatatactaaagtttacaaaaagaggattttgggggttatgtaggttaccattattaaatacccaaataagattatttctataagaaacactttaaaacaccactcacctaccaccatccccatgacaaaattaaacactctccttgtgctcccacgagtactaccattttcctctatagtattaccaacatctctgatgtatgacagtttgttacatttctttcttttttctctctctgcccagggatatcttgcagagcaggtattttgctttattcccatttgatttccaacaatcccttacatggtacattctatctagcaagtttcaataatggatgttgaatttaatgaactaaaaaagccccggatgttgtcaagattgcatttgtttatttaatgtatatagttgttcaaaagttcattaatggggtccagttatgacacagtaatgggtatgatatactcttctgctgtaaaaaaaaagatgtaattgattacaatatatgaagtccttgtttttaagcatttaggattttgatcctctggagaagtaaacacatgagatgagctcaatgttactctttctccttcagggcattttctaaattgtggcacagagaagttgtgccctaatgaaactgatctctgggtggagaaaacagaggttgtcacccagggaaactgagatgggtgaaatttgcaaggcaaggtgccacagaggagagagctgtgcagtgacttccagtgaatctgtgtgctggttctcagttaaactacagccaaatatttgaatctgtggtcaaatatacccagtgccagcacagggtaattgcctacaagaataccagtaggtgggttcatttgattctttgaggcatggccttaagctttgccattacttttaaggctagagcaatgctgatctaagatatacttttctggggtctcagctgatcccagattatggaacaagctctctactgtagcttgtttcaccttcaatgtgtcatgtatgacatctggagtctctgttgagtttgcagctctctgggacaataagtgaatattttagactgtatgccagtaaattaaacaaactaaatgaattgaacaaatttcttgaggtacacaaattttcaaaagtgatttaagaagaaagaacatttgaataaatcaatttacatggaaatgcacgtaatctagaattgccaattcaatgtgaaaaaaataaagttggaggagttatgttacttgacttcatgatgtattaaaaagattatcatctgctgggcttggtagctcatgcctgtaatcccagcactgtgggaggctgaggattgtggatcacttgaggtcaggagtttgagaccagcctgatcatcattgtgaaaccctgtctctactaaaaatacaaaacttagccaggcatgttggcgcatgcctgtaattccagctacttgggaggctgaggcaagagaattgcttgaacctaggaggcagaggttgcagtgagctgagatcgtgccactgcaccctagcctgggttacagagtgagactcggtctcaaaaaaaaagagaaaaaatgatcatcatcaaaacaatattacattagcattaaagacagactaatagatgaatagaagagaacagaaactctaggaacaggccaagatgtgaaaaatgatttttcaaaaacagtataaaaataattcaatggaggaaggtagctcaatgggggaaagtcttttcaacaaatggtgtaagagtaattgaatacctatatgccaaaatgaccatccttgaacctagaagaaatggacatattcccagacacatacaacctaccaagactgaatcaataagcaatcaaaaatctgaatagaccaataacaagtaataatatcaaagccataataaaaagtttcctagcaaagaaaatcctggaacccaatcaatggttttattgctgaattctaccaaatattcaaagaagaactaatacgaatcctactcaaactatttcaaaaaatagaagaagagggaatgcttccaaatactcattgtatggggccagtattaccttgctaccaaaacacatgaaaaatcatcaaaaagagacataaaaaaccccaaaacaaaattacaggataatatctctgatgaccattgatgcaaaaaccctcagcaaaacacttgtagtccaaattcaacaacatattaaaaagattattcatcatgaccaactgagattcattctagggatgcaaggatggttcaacatattcatatcaatcagtgtgatacagcatatcaatagaatgaaggacaaaaactgtatgattatttcaattgttgctgaaaaagcatttgataaaattcaacatcgcttcatgataaaaagcctcaaaaaattgggtatagaaagaacatattccaacacaataaaagccatatatgacagacccacagctagtattaaactgaattggaaaaagtgaaagcctttcctctaagttctagaacaagacaagcatgttcactttcactgccgttatttaacatggtactgggagtcctaactagatcaatcagacaagagaaagaaagtaaaggcatccaaattggaaaggaagaagtcaaattatccttgtttgcagatgatataatcttatgtttgaaaaaaatctaaagaccacactgaaaagctattagtactgatttaaaaattcagtaaaattgcaggatacaaaaatcagcagcatttctatatgccaacagcaaacagtttgaaaaagatatttaaaaagtaattctatttacaatagctacaaataaaataaaatacctaggaataaacttaaccaaagaagtgaaagatttctacaatgaaaactgtagaatactgacgaaagaaattgaagaagacacacaaaaagtggagatattctatgttcatggattggaagaatcaatactattaaaatgttcataaacacaaagcaatctacagattcagtgcaatccctatcgaaataccaatgaaataaaataaataaaatttatatggaaccacaaaaaaccagaatagccaaaggtatccagagcaaaaagatcaaaactggaggaatcacactacctgacttcaaattatactatagagctatggtaaccataacaacatggtaccggcataaaaacagacatacagacaaacaaaactgaatgaagaacccagaaataaattcatacatctacagtgaactcatttttgacaaaggtgccacgaatatacactggggaacgaacactctcgtcagtgaatggtgctggggaaaccagatatccatatgcagaagaattaaaccagacccttatctcttgcaatatacaaaaatcaaatgaaagttgattaaagactatgaaactactaaaacaaaacatcagagaaactctccaggacgttgggctggcatacatttattgagtaatatcccaaagcacaggcaaccaaagcaaaaaaaacggacaaatgggatcacatcaagttaacaagcttttgcacagcaaaggaaacaatctacaaagtgaagacacaatccacagaatgtgagaaaatctttgcaaactatccatctaaaaagaaactaataaccgaaatttataaggagctcaaacaactcaataagaaaacatacaataatctgattaaaaatgggtgaaagatatgaatagacatttctcagaagaagacatacaaatggcaaacaggcatatgaaaatgtgcttaacattatttatcatcagagaaatgcaaatcaaaactacaatgagttatctcaccccagtaaaaatggcttttattcaaaagacaggcaatgacaaatgctggtgaggatgtggagaaaagagaactctcatacaccgttggtgggagtgtgaattactacagccactatggagaacagaatgggggctcctcaaaaagctaaaaatagagctaccatatgatccagcgatcctactgctaggtatatacctaaaataaaggaaatcaatatattgaggagacatctgcattcccatgtttttggcaacactattcacaatagccaagatttgaaagcaatctaagtatccatcaacagctcaatgaataatacaaatgtggtacatatacacaatggaatactattcagccataagaaagaatgaggttctgtcgtttgcaacaacatggatggaactggaggacattttgttaagtgaaataagccaggcaaggaaagacaaacttctcatgttgtcatctattttggggagctcaaaattaaaacaatctgactcatggagacagagagtagaatgatggttagcagtgactgggaagcgtagtgggagggtgaagatgggaaatggggatggttaatctaaaaatatagttagatatgaagaatgatatctagtatttgatagcataacagagtgactacagtcagcaataatttgttttatattgtagaataactgagggagtacaattggaatgtttgtaaaacaagaaatgatgaatgctagaggtgatgaaaacctcatttattctgatacgattattacacagtatatgactgtatcaaaatatgtcatgtactccataaatgtatcctactatgtatccataaaaattaaaaatgaaaaaagatgactcttgaactatacttatactgtgcacaaaaattaatttgtatggagtctgaacataaacataaaagctaaacctataaagctttaagaagaaaacatcgaaaaatacctttgtgatcctagagtagtgaaatatttcctggataagacttggaaagtgataaatgtaaaagtagataaataagcttgatcaaaatgcaaacttctgctcatcaaaagatggcattaacaaaatagacaaaacacagcctacgagacaatacagacaatataaatttctaacaaagtacttgtatccagaatatatgcagaaatgctacaactcaataattttaaaagtccagttaaaaacagatgaaagactagaatagacacttgacataggaagatatacaaatagctgatgagcacaggaaaagatgctcagcatcgccagtcatcagggacatgcaaatgaaaagcgtaatgagatactaccacatacctactacaatcactctgcaaaagaatattttggaagtttccttttttttttttttttttttttgagatgatttcactctgttgcttaggctggagtgcagtggcaagatcatagctcactgcaaccttgaattcctgggctcaagagatccttccaccacagcatcccaagtagctgaggccgcaggtgtgtgccaccacacttggttaatttttaaattttttttagagtcggggtcttgctatgttgtccaggctggtctcaaactcaagggtcaagtgatcctcctgccttggccccccaaagtggtggggttatgggaataagccatgaatttcttgagaagttaaatgtgtatctgtcttaggacccattactctccttaatgcttacccaggagacatgaaaacacatccacatgcaggcttgtctatgagtgttcaaagaggctttatttggaatagccccaaagtggaaacagtccaaatttcatcgatatgtgaaagtataaaaaattatacctattactctagaataaaaaagaatagactattgatacatgtgacatgcatctcaaaatcattatcatgaatgaaagaaaagaggccaagaagattcatactgcatgattttcttcattgtaggagtctagaaattgcaagataatctacagtgatggtaaacagatcagtatttgcctggggacagaatccgtaactccatggattccatgggtgtcagagttgtgctctgacttatctgacatatatcactatttgatggacaaatgatcatataaagtgaaaaatcaacctctaaactaagagtttgggatctaactccagaataacaccagtaacctctgtgtgtctcattggaagaacatatgatgcttcgaggatggttatgtcagagagcaaatgagatggtgtgtgaaaaataatagtaattataagatctgatataaatttaatttattcttattgtttgttattaatagctagagataagcctgaaattataatttcatagctcatcagtgagggcaatgaaggatttgcatcaaaataagcttcggagtcagtctctctctctcacatgcatacacacatacacacatgctcgtatgcatgcacacacacaaacatacaccactcaggtttcatagacattatttctggagataaagagtatggctctgaattttgtttctaatgctgttggttgtttgcatgctaattctagactaggaatcaaatcctaaaacgtcagttatattgtgtcccactgtgacgaccaagaatggggctctcacctctgcctacctggctcttcacgtgaagtcgccttcctcatttgtccactctcaatttacacctattgcctcagtatggttattaattgtgctttcttacattttgagtgttatgagctagacagtaagttaacattgaattaatatttctggtttggatctacaaggtgggaattattcccactttaaagatgaagcaaatcacttgtctactacgctacaacattgtcttagagaagggagaccaagactctgggtaatacaagactgaatacttactgcgtgtccactctatgcccagtactttcgaaacgctttccatatattagctcatttaattttccaaaaatgctaggaggataccaagacattagtgttattacagattacgaaacaggcatgagaggctaagtaacttgcccaaggccatggaacaagtgagagatggaactggatttgaactctggtaccccagctccagagctggtgggtaataattacttgctatgaaaagtattacaaggctttcttttttgtgttgcttctacctggtacaagaatcttgatgagccaagagttactggaacttcagtaagctcattacttgaacacatttatttttaaccattttcccccccacatagatttggcattattaacagagccaaagccaagtgacgttggcccttgataaagacacagcttatcagagcctgtgcccccttccccctaggcatcttctatcactgttgcaggtgcaggccccctccacacccactctggaaagctgagggttgtggctggttctccttttctaggacattccctgaggccacttgtggcagccgccaatgtgcttgctcttcctattttatccttccaggcatgtggcagctttacctaatgaccgaactcccgaatgttcccattctgtcctgcctctcttttccccttactccaagaatgacccattatgggttattagcactgccctgtttttaactgggttgcaattcatgcagcctcctaactgcaaaatcacttccctacagccttccttcagacaaggtggaactggccccagaagctgggtgtttacaccaaagatttttttttttttttcgaaagctgccttctgttttgctcttcccttactgtataacagatagcagggtgcaaaaagccctttatcctgttaatagtggccttaggtaaggaaaaaaaaagagcatgattcaagttttctgtggcctctggctcagttgaaatggaatgtaagtgcaatgccagagcctggtaaaaatagaaactccagtgtccagactcctctccagatggtgtgggaatccagatagcaactcatcactaaggagggccaccattaattagtgggaagatgtcatgcctcacactggggagtaaatgaaatggcctatagcttagaatggaacctctctaatcgccagagagtccgaggtttctccctaagtctctttactctggcttaaccgagagttcggtcattacataaagctgccacatgcctggaaggaggaaataggaagagcacgtgcagtggctgctgctagaagtggcctcatggaacatcctagaaaaggagaaccagccacaccctcagcttcccagagtgggtggggagggggctggcatctgtgataatgagagaagatgcctagagggagctggacccaaactctgataagctgggtctttaccaagggccaaagtggcttggctttggctctgttaataatgtcaaacttatgtcgggggtaaagtgctataaaaataaacatgttcactgaacgagcttactaaaattccagtaactcttggcttatcaagtttcttgtatcaagtagaaacgacacaaaaagaagccttgtaatacttttcacagcaagtaactattacccttcataagaatcacaaatctaacccctttccattaagcatagcctcctaaaaggaattagctttgggccctgggcaagccactgagctctgctagtctccccttctttatcaatgtcatgagggtgatcatactgattttcagattttcacagggctgcttcttttgataattaaataataagaaggtacaagaatcaagaagggtgacaagcacatgggtggctaaaaatattaactgaagaaatcaaagcaatacaaatgtttggcaccactaagttagaaagagtgtatgagaactggagggaacccctctgctggtcaatttttattatttggagtaaatgtcatctctcagagaagctgttctcaaagatcatgttgcattgttaattttggtatctgtctctcttaatagacagtgaaccttcaaagtggggaggaccatagcatgttcaggtctcattatagcatgtagtgcataaaggtgcttggatgtttattgaataaaagaatgagtgaagatttggaataatggaaaacattgggaagggtgtttcttttggtgggaatgtagcatgatgcaaactaggaagttacttagaatgtccaggaaaagacaggagagggcagcgtgggtggaaaacaggaattgaggagtactgagcaagagacacaccaaagaggccaggacccatccaccttatctcctcacctataaattctgctcccctcctcctttgcaaggtccaagcctcacaatgtggctccctctctacaccatcacctcctgctcctctttggaaaaggaaccacagttcccaagctctttatactagacacagggcaatgcattctgcacttattttttctaagttcatactttgaataagtaatacatttacgtggctcaaaaatgagaacactgtaacaaattataccctaaggtgttatacccttgactttatttcccctatcccccttcaatccctagacataatccttttaattagtttcttttttattcttccagtgttttatgcaaatataagaagtatgtctatatattatttacttatgtttcctacacaaaagattgcatactacatatacttctacatattgctttttccacttaatacaacctggtcctcttttccctatcaatgtgtaaagatcttcatccttttttatagctgtgtagtattccattgtatgtatttagcatagtttattcaactaatcttctagtgctggatttttttcattatatacactgtggaaatgaataactaaaattttgaacagtttttttaacttagccttttacctgattgttgatgccttttcttctttggtgatcttggcaattcttaggactctatagatcacttctatgctgatgacaaagccccattgcggtgtgcatcccctttcctgcttctagctgccttcctgatctattacaatcaacagcaactctaaacttgacctcattttctcctcctttgcttaggaggttttcctagtgaaaagtatacactgagatgtcacattctctctcctactcactaagataagaaacttcagttgcctgtgatttcttctctgccttgaactctacatccattgggtgtaacaaacacattgttttcttgcataacattttggacatatgtcctttctttttattcttattgtcataaataactgatttttccacttttctcttacatgtcttctgcaataatctagacagctttggtaggaaacatctcacaacttgggtgggatcatttttctgccattagaggtatcccaatgcctaatgaagaaagtgtacattgctgtttgtaatgagaaacttgctttctctttattgatgagtgagctctttaggagtagacacctgccttatttactacaatacccttaccacctgccatgatgctgggcataaggtatgtgttcagtaaaaaattgttgaatttatctctgcaatacaatttcaacgggcatttccaatcttatctcccattattcccctaaacaaactttactgccaaagctaatttgaactattgtccagatatactatttaactttcatgacttggattatgccattctctctgcctagaatattcttcctctgtctctatgtgttactctgttcaggtactgaaaagccaacagtttccaaggcccagcacctctgagaagttctatctgattaccctgaaaccaccgaggcccaaaagaaagcaacttcctcagtagaggaaatggaaccagaaccctgatttctcagctctcatgagcctagaaagagtagagactctaagatccagaactgcacattctatttcccagtgagccatgacatcctgccttggaggccagaatgatacttgtcttacaactttattggataatagggaggatcccatggaatgatggaattagtaatcatttataaaagcacaaaatcttataaactgtagtgaagtatgtagtgcatttctattcaattaaataaacatgtattaaactcctacctctactatacactgagcaatgtgctacaaatggaatggtttcttcccacaaagcgctgagtaagagaaagctgtggccttattgaatctattgatttagcctcaataaatgcagaaggatgtcatctactcacacgaagataaaagggttacaatcatggacatggcttacctctctaaatagctcgctatataattttggcaaagttccttgaacaatttggtccttagacttcctagattgttcatggaactttcttcttagattattataccctgttctgtgtctcagtttgcaatttttatcccagcagaggaactctagttctaagagggagatctgcccttgaaaaccggctgcccttattacttcctgcctttcttttaactgagctccactggctcagacacataatttttgttaaccatgaatgctttaataaactcagaggtcgaatcaataaagccaagatttttgaccaattgtggtcaacacaagtaccaaagtaaatttttacaaaagggtcaccattcaatttctagtaatttagggcaaattccacgttgggttaatttcatgctgcatttctgaattcccaaagcagtttctacagaatgtcatcatgactatgggttttttcccttgatccgtcctaagacttggtgacaggcaacaagcctgaaacagccattctatttcactggggagagagattgcatgtgtacctggaatgaaaccatctgctagaatcttgcagcagtgtgataatggagaataaaatggagaattgttcaagggtcttagttgaaggtaacagtatttacgggatgacctaaaacaattcaaataagaaagccagctttaagtaacaatatcccactgctatgtcacactagtgaggcagctctggcatggtccagcttaaaatatggctagtgatttgattgtaaaatattagctagctcactggagagctggcacaggactttagaggagacctggactcattttttcaggtctcactcttcaacctcagcatgcccactcccatagaatcatatatgaccaacacatctttgttccttggatggcacgtttgcagttattcttaatgagcatgcttcctactcaactgacccgaaatagtttgtaagtaaaataaagagaattgccctaatttcaactatgattaatcaattagttgaaaaatcaattacctgacaaaaaaaaatccaagattcacttcgcatgactttttagtctttcatcatttcccacatttgtgctcctgtgttcaaccagctttggaagtaaattaatagaaaaagatgaaggaactgctttgaatccatacaagacatggtttatcaaacagttcactagcaaacatagatgaaccttgggtgcatttctttatcatcatttttgtgtgaggccctagggtgagaaatagaaatgaaggctggattctgtccatttgggtctcactgtctagctttctttcttttcttttttttttttgttgagacggagtctcgctctgtcgcacaggctggagtgcagtggcgcgatctcggctcgctgcaagctctgccttccaggctcacgccattctcctgcctcagcctcctgagtagctgggactacaggcgcctgccaccaccctcggagaattttttgtatttttagtggagacggggtttcaccgtgttagccaggatggtctcggtctcctgacctcgtgatccacccacctcggcctcccaaagtgctgggattacaggcgtgagccaccgcgtctggccctcactgtctagctttctaaagacaaactggtatttacaccaatctctccttgtcactgccactaaactccagtccactagagcccactcagaaaacctttctcaactgatgggagcataaagtttgagattttgcgatcactcttaaatttcttctatgttttagatggatataacttaagatttgtaaagttccaaatcttcagatatagaacatttccagcacctcagaaggctccctcatgctccctccctataaaggtaacaactattccaatctctgacactacagcttagttcgatctgcttttgaacttgacgtaaatgtcgtcacgtggaacgtactatttgtgcctgactttgtttactcagcattacctctgcgtgattcattcacattgttatatgcatcagtgctttgttcctttttatttatagtaggaatataacacaatttatttacctattccacaggtgatgggcactggaataggtaaatattacaaataaagcagccaaaaacattcttacaaatatctttgggctgatatgtcttttctaaagaaatcaaaatttctaatttaataaattatatgttttctagcttggaagacgaagacaatgagatctaatgaaatgagaggctgagaaaactggacctgattagatgcatccagacgtaatctgtgcaaaaaccatgttttttccttcttcgacattctcatgcctgcttcttcctcctcctctgctcccactcttagcagtggcaactcctggtgacctatttttcttctgaggcttttctcatactatctccatattctgtcaactcataaccactcagaaaatttaatatcgaataactgatactcaggttaaaataatggttacactactctcctgaataatcaaataactaataggtttaaataataatgacactactttcttaaggatatatgcttatttacaggaaacagggatctatctctgtggagaaattttagaagtcagtaaagttcaggagatagtttttgagtgggtaaaactgattttcagtaccagaaaatcataaatgagcatctttcttgtgaagccagttcttaatacatccaaaaaagggagttgcctttttatttttatttatttatttatttatttatttattttctttattattattatttttttgagatggggtctcactctgtcacccaggctggagtgcagtggcgcggtctcggctcactgcaagctccgcctcccgggttcacgccattctcctgcctcagcctcccgagtagctgggattacaggcgcccgccaccacgccaggctaatttttctgtatttttagtagagactggagtttcaccgtgttagccaggatggtctcgatctcctgaccttgtgatccgcccaccttggcctcccaaagtgctgggattacaggcttgagctaccacgcccggcctgcctttttataatacatttaattttttaaaaatgctgataaagacctctagtttgatatataattctcagagttgcgctatcgtctaactacaatttttcactcatacccttcctgtcaattgaaagctaagggacaggtaataaaagactacacttgcattaatagtaaaacatactagggaaaagtttttcagttacagtttcagaaagttgttcagttgctatgagagtggaaactaaatatttgcttccttctattacaaacacagcagaccaacctaacctaagtcaccaaaggagcagttaaaatcattttcagtgacatcgtggggctaggctttttaaagcaggattgagaagaaggcaaaacaactataaggtatccttttgttttttctttcttaacccactcatctaactttctgcctcattgagcttccttcttacaaataaatgaattaattaagaccctacttgcaagaaaacctgtggttaaaagggatcttaattcctcttgcatctatccatccatccatccatccatccatccatccatccatccatccacctattaatccagtcaaccatccctcaggtgcttggcctggatcccaggctggtgggttacactgtggacatccatcctatgcttgagtgtttccagtgatatggaattcatacaagccaagcagccagctcagttctgacaaggtaacaaagttgcctaattagaaagtaatcaatagctagttttgataaggtggcattttttctcattattttatttcccatttttttaagcttttttttccaaacactgggaaaataggatattaaaaacaaaaagcaatttcatatgtaaatgtctttttagactaggctcaaaaacctggacacagtgaaggatgatgttgacagctaacatttttctatctgacttggagcaggtgaaagatttctctacaagtgacatggacctgccaagccaaaccagtgatcctcaggtcaggccaagctttgtaacttggggcccacagatgtggtttgtttagctagcacaatatttttaaaataatgagttagttgccaagttttaaaattagactgtttcacataaaatttgagtctggctgatcctaacaaaaagagggtgcttatttatttttataaagtttttttcttagctttaaaggagtggttttagtgattactatctcctatggtgaaaaaaaaaaacatacttcctagaattaaatgattcctttctaaaatttttcatttatttatgtttctagagacagggtcttgctctgtcgcccaggctggagtgcagtgatatgatcatagattactccagcttgaaactcctgggtttaagcaatcttcccacctcagcctcctgagtagtagggactgcagaatagctgagacttcaggtgtgagccaccacacctgcctaattttaaaaagtatttgtagagatggggtcttgctatgttgcccaggctggtcttaaactcctggcctcaaggaatcctatcaccttggcctcccaaaggccaaggattacagctatgtgccactgtgcctggccaagtgattcctttcatttagctttaattttacttctgttaaataatttaaatttaacacttctttaaaataaagaaatatatatcatctgttttataattttctttctctccatctatttactcatccatctacccttccatctagagagatgtctagatttgtgttggccaaatgataatggtggttactttaggatggtggaattttagatgacctttaactttctattttgtattttgctgtgctgaatttttagtactcaacatatttcatttttatataacattagtccttgtcatttaagaagtcctttaaaattaaaatatgtctctcttcttttatctcttgaactgaacctttaatggatgtgattaagtgagatctaaattaatggtgaatgccctttttcaggtaacaagaaaaatgtgaaaatttgagcttccttattagacaggcttctcccctgatatcaatccttatgtatttaactcactgtagtaatttagaaaaacatgttttatttcttttattggtcaatataatttagacgcatgggccaaagtatcaaaaatttccactaccaaatcctcaccaagacttactgggttaaatcttgtggtaaactataataggataacagtcttaaatagatacttgaaatcacatgcagatttccttttctggaaatagggcattctagaatactgaaaactattttgccagagaacacctagacagagtggaaaaagttgataagctttcttttacatgcatggttaggtttgcaagatagtaaaatttttccaagggagcaaaaaattatccaaagcactaaaacaagaggtagcaaaaacctaagtattaatgtaacactgatttcaagctaccttatgggatttgttggtcttgacaatcaagtgatgtgggttgcataaaccacatcaggacagaagatgaggccttgggcttacataaaattggaaggaaaataaacagagatccctacatgcaagcttgaaccctcacagagctaggcctttagtgaaaggtagatgactaggaacctgatcagtctcagcctggatactgtttgtgggagagaaaggtctctgttgagtactgaacaagaataaaaataaagcataccaaaacttgtagaatgcagccaaagcaataattggaaatgtgcagcctcaaatatttctatcagagaagaagaaggctgaaaattaatgagcaaagtagctgtctgtgttccctataaaacaaagggtaaggcagtgagtgattaagtgctaatgcttctctggagaggttccagggcagaaggaatgagagaaaagggaaatgagacagggcaggatgagaagcaagggagggggcgtgtccaggtgctgctggttgctttatcatgagccttgaaaagtcgctggttccatggcagctgtacccatttggtcactctttgggatctccagaaaggcaagacacagaaacagtgcctcacagcagcatcccgaggagtcgtccctcttagtgtaggcctgagggcgtggggaggagcagccctacaggatagatgtaaaatcccacctggatctgtctttcctatatttcctttggaacaaaagccttaaattggtgtgggaaggacacaaaccctgtcaccttcaaggaattggagaaaatccactgaaactggggaagggcatgagaaaaaccgtattccatgaaggtgggataaacttgctgggttcagacctattgattgggatcaaagcaaatcactgagggactcctctcctgagacccaaggatgcagtgcctgccaaggacagagacttaaccagagcatcagagcccacccatgtgctgcccctggaaccagtgtagcatacattgagtaacaagtaacagtggtctatggctgggagaagggcaaaaacaacaagagaggtgctcatggtgtatgtgtgtgtgtgtgtgtgtgtgtgtgtgtgtgtgtgcatccacattgtgtgcacacgctcatgtgcacacgcctaacacactgaggcagcctgcatggcacccagaccagagcacctgtgcggtcacacaaacactcgagtggacactggctcactcacacctccatgtggcacctcagcgcccaccagctgctcagtaccttgtccacacacacttcttgtagcacaatgggaagacctaaagcggaatatggagaagaccctatgaaagcccctggcatgccagcccccatcctacaggagtttgaacctccctctcactctttgcaacaaactaactcaaacatgtcatagactcaaatgtaaaactccaaactgtaaaacatctagaagaaaatgtagtagaaaaatctttgtcatctggagttagtcaaggattctggggttaaagatttcttaactacaactccaaaagcatgacccataaaagaaagaagataaattgggcttcatcaaaatgaaaaactgttatttaagaagtctgtgctgagagaatgaaaggcaagccatatactaggataaaaatatttacaaaccatatatctgataaatgacttgtattcagaatatacaaaaccatcaaacgaagtaataagaaaacagacaattcaataaaaatagaattgaaataaatattgggacacatacttcaccaaaaagataagcaaatgtcaaataagcaaatgaaaagatgctcaacatcattagtctttaggaaaatgaaaactaaagcaacaatgagataccattttacatgtattaggatggctaaaaccaaaacgaaaacaagaacatcctgacaattttgtgtactggattgttcatatattgcttaaaagaatgcaaaatgatacaaccactttggaaaacagcttggtgatttcttataaagttaaacatacgagccgggcactgtggcccatacctgtaatcccagcactttgggaggacaaggcaggtggatcctttgagttcaggagtttgagaccaggctgggaaacatgaaaaatgctgcctctacaaaaaatacaaaaattagctgggcatggtggcagatgcctgtagacccaaccactagggaggctgacattggaggattgattgagcctgggaggttgaggctgcagtgagctgtgattttgtctctgtactccagcctgggtgacagagcgagaccttatctcaggtaaacaaaaacaaaaacaaaataggcttatcctaccacccagaaattcatttgctgatgttaacccaagttaaataaaaacttgttcatttaaaatctgtatgtgaatgtttacagtggctttagttacaagagccaaaatctggaatcaacacagacatacatccttcagctggggattgatgaatacactgtggtgtatccacatagtggaatgttactcagcaacaggaaggaacatcccaacatatggatgaatctcaaacacattacgctgagtaaaagatgcctgactccaaaggctacaaactgtatgactccatttatatgacatttttacaaagacaacactatagagaaagaaaactcagtggttgccaaggatgggggtggacagacggtttgactataaacagacatgagaaaatttctgtgggtaatagaacttttctgtcttttttatggtcatggcatgtgactgcagaaatttgactcacagaactggacactacaaagataaattttagtctatataaatgaaatcttaatattaaaaatgaaataatattaagtcaaaaagaattccatggtatgtcactatccaaagacaaccttattaacatttttttgtttgtaaaattttctgaaatcatttttaaaaaactgcacttgctgcttcctacacgtgaacaatagacccagaaaactttacagatgagttttaccaaacattcaaggaattgatggcttaactatctcaaagtataatacataggaaaaggggcaaaattttcctagttcgttttatatgactataaataaaaagaaccaaacagaaattctggagctgaataatacattaaaaaagaaccaaagagagattctggagctggataatacattaatacctctggaaatgaggtacagagcgtcaacagcagacttgatcaaggagaagaaagaatctgtgaataaaaaggccagtaatttgaagttatccagagaagaaaaagtaaaaaaattaaaataaaaaaagtgaagaaagactccaggatttatgaaatgttatcaggtaaaataatacatgcataatgaagaatttaagaggaaaagagagagagagagaaagcggcagaaagcttgtttcaagaaagaatggttgaaaactttccaaaacttagaaaggatgtggacatccagacttttgatgttcagacttccaccaaaagatcaactcaaagatgattacacagagacacattataatcaaattattaaaagtcaaagacaaagaggattccaaaagcagcaagagaaaagcaggaaaattccatgaggctatcagtggatttcacaggagaaaccttgctggccaggaggggagtgatatattaaaaatgctgaaagaaaaagactgccaacaaagctgtcctccagaattgaaggagagagaaagactttcccagagaaacaaaagctgtgggaattcttcaccatgaaactgccttataagaaatgataaagggagttattcaagttgaaataaagggatactaataagtaatttaaaatcatatgaaaatataaaactcacttttactctagtataaaagttaaaatacaaaagtattaaaatatagctacaataattaataaataaacaatacaaaaagatgtaaattgtgatatcaataaatcaaacgtgtgttgggggagagaaattagagggtaagtttttgtatgcaattgaatttaaattgctattagcttaaaatagattgttacaactataagatgtttgatgtaagcttcatggtaatcacaaagcaaaaacctttagtagatacacagaagataaagaaagaaatcaaagcatactactacaaaatatcataaagaaacattgtaatataggaaaaaaggaactacacaacagtcataaaaattaataaattggcaatagtaagtagctatctatcaataattactttaaatataaatggattaaattcttcaataaaaagacacagagcacctgaatgggtttaaaaaacaagatccaaaaacatgctgcctagaaaagactaactttagctttaaagacacatctgaaagggaagtgatggaaaaaagatattgcatgtaagtggtaaccaaaagagagcaggggtagctatacttacaccagacaaaatggacttgaagtaaaaatctgtcaccacagaaaaaaaggtcgttatataatgataaaggggtcaattaaccatgaagatataactgtaagtgcacccaacactacagcacccaaatatatgaagcaaatattaccaaaactgaaaagagaaatagagagcaatataataatagtagtgaacttcagtaccccactgtcaagaatggatagatcatacagatgaaaaatcaataaagaaataccagacttgaattatactacataccaaatgctaacagacgtacagaatatttcatccaacagcagcataatatatgtttttctcaattgtaggtggaacattctccaggatagatcatatactggaccacagacaagtcttaacacatttaagaaaattgaaatcatatcaagtcattttttgaccacaattattgtcaattattacctcaatagtgctggaaaaaaagtgtacatctaaatctcagccccagggatactttcttgactaaacatcattgatcaccacaggtttactttgtctctctttggctggatagtacagccattctcttctcagtgtagacttttcaccaccttccccatgacatagactgagcattttctggctctttgcaccttacactttctcaccttacaaatccatgtatttgtgggcacatgcaccatatgcccacatgcctatgccaatatgcgagcattgttagacagaatcggcttgatgacactgagattctgggaaaatgcagcttctataggtaatgagcatatatatctagtcacatttaaaaaaatagaatttattttgagttaattgtagattcatatatggttgtaagaaataatacagacagatttagtgtaacctttaccatatgcattaggccattttgttgttgttgttgttgttgttgagacagagtctcactctgtcgcccaggctggagagcagtggtgccatcttagctcactgcaacttccacctcctgggttcaagcgattctcctgcctcagcctcctagagtagctaggattacaggcaggtgccaccacacctggctaatttttgtatttttagtagagatggggttttgccatgttagccaggtggtctcaaactcctgacctcaggtgatccacccaccttggcctcgcaaagtgctgggattacaggcatgagccaccacgcctggccacattaggccattttagtgttgctatgaagaaatacccgaggctggatgagttataaagaaagaggtttaattggctcatgttgctgcaggctgtacaaacatggctctagcatttgcttctggtgagggcctcaggaagcatacagtcatggtggaaggctaagggagagcaggaaatatcacatggtgagagtgggagcaagacagagcaagggagtggggaggcctcagacttttaaacaagcagacctcgagtgaactgagaactcacttttcaccacggagatggtgttaagccattcatgaggaagccaactccctgatccaatcacctcccaccaggccccacctccaacattgggaatcacatttcaacacgagatttggagggggcaaacattcaaaccacattaccaggtttcatccaatggcaacatcttgcaaaactacggtacaatatcacaaccaggatattgacaacgatacagtcaagatacagaatagttccatcctggcaaggagctctcaaatagtccttttatagccatacccacttcccttctgccccaccccgatcttcactcctggaaatcactaatctgttctctatttctataattttgtcatttcaagaatgttatgtaaatagagtcatacagtatgcaatcattttgggattggctttttccacttagcattattctctggtacttcatctagagaatgttgcacatatcaatagcttgctattttttattgctaagtaggggtgtattaccatttgcttaacccttcattcactgatgaatatctggattgtttccagtttggggctattacaaataaagctgctgtaaaaactcctgtacaagttttttgtgtgaccataaattttcatctctctagaatatgtggccagaagaacaactactgggttgaatggtaattgcatgttcatatttttaagaatttgtgaaagtctttccaaagtatggtatcgtggttgagagagaaaactgtggagccaaaccaagagatatccaccacttttgagttgtatgtgtcttgatatgagagcaaatctctccaagactcagcttctttgtctataaagctatgcctacttcataaaatgttttgttaaattgtctgagggctaaaagggattatacaaacaagttcttagcatgcaactactcagaacttgaaatgtggccaggatcattgaggaagtgaagcttttcatttactcaattttaagtcacttaaattaaaatagccatacatggctagtggctactatatcagacagcacagatttacattcttacaaaatgaagattacaataatcctcacaaggttgatgcagaatgaagaaaaatgcaaaagaaaactgcatgaaagacattgtagtatacaacctaaggtgctatttatagacaataacttactcaaggatggtttagatacaggctgtattagtctgttctcacattgctacaaaggaatgcctgagactgggtaatttataaagaaaagaagtttaactggctcatggttctgcaggccatgcaggaagcatggtgacttccgcttctggggagatctcaggaaacttacaatcgtggtggaaggtgaaggggaaggaggcacatagctggagcagaagcaagaaagtggtgggaggaggtgccacacacttttaataaacaaatctcatgacagctcactatcatgatgacagcaccaagggaagatggtgtcaaactatgagaaaccaccctttgagtcagtcacctcccaccaggccccacttccagcattagggattacaatttgacatgagatttgggtggggacacagatccaaaccatatcacaggccaagaaagtttttctctcctttccaactgtgaactgtaattttttgttataggcattaacagaagaacaaacaccagcaagaaatgaacaaaaaatgggggagggcagtgtcatgaagcaaaatatgtggctagcctttctgcaaagtgtgctcttgtctgtgacacatgcttctttggccacatggtatagtgtctgccttccacactgtcacgtgctgggggctgggcatgggcggtgacttccatctgcttcctcatggagcacagcctcacagaattcatcatcaagataggtcatgaatgggaatgcacaccagtgtaatatctttgtccctggtgagccgtatctctgataccttctaaaatgttagctagagaaagcagaggtgtttcattgacaggtaattattgttctctcataaaaactgaattctatgaagaacaaaacctttcctccatcttggaagttgggacaaatgcactggttcggggagcgctgggctaaggatcaggctgcttgggctatcaacatatttgtgtcaccacctatctaagtggcaccaggaagcccaccttcctttttcctataagacagaggatcaggactagttggcctaggacccctaccaggaccatcatttcatcactcatacttgacacctcatattcttgcaacttcaagggcacaaccactctctgatgtgtgttataattatagttgtcaaggtgaagaacccgaggtaccataagactatggcttggtcaaaaccccacaatatagtaagacagcggcagaattggaaatgaaatcttcatactccaagcctttctttgggtctttgttccacgctatgttactctgggctcatttagaagaaagtattgccctgggctggaaaatggagtgcccaatgaatagagctgcttctttctcctccccctgcctcttcttgctcagcccccacacctgctgtactggccactgtctggatgtagtaggagagagaagaaaagcagaacaaaataggtagggggcaaggaaagagaaaggtattagaaaggtaatagaaaggatatataatatttttccatctgttcagaaagaaaggcacttagaacttcagaagagccagcatttttacagaatcacgaacagtttaagcaagcaaggacagagaagtgaagtgactcatcctgggtaacaggggtctatctagtaagcaaaaactaataaaggatggcaaagcataggaattaaggccaactagagtctccgtgtcagccctgttgcatgcccgccgggaagccacggtcaaggcagcctccttcaaacttcgttttttgcatctctgaaaggaggccatgataccaacattgtaaggttattgtgaggatcgaacaaggtaatgcctgtcacacagctgaccaaaatttaagagcttaatagaagagaaaattgatgagtttgggctagaacccagatattcctgttcaatcgagtgctcttcccagtagaacacgctgcccctcccccttcctccctttttgctcaatgccagcatgctcccttaagctctctaattagctaaataaagagtgcagacagggcctatgttaaaaaatgctttctgagccaagtgaaatccctagggaagtgaaaagaaaagaaaaaacacacacatggccaattaccatagcatcatttcatttcctcagagtgactaatacccagagacagtcacttaaacactaattgcaggagaacaggtagaaatcatgttaaatgagcccatctttattcctggaagaaaagacagcaagactctccaatgcatgagtatgtctgcctcttaatcatctgcagaaagagaaggcagcttccttctctgattgaacattggattttgatggcatcgtagttcttcttgaactagccggcagatctgcagtgtggaattgagttaccagtggagcaacatgccagcttccttctgacagcgtttggttgttcagaattcaagcatggcataaaacaatgcctgcatgctccagagagacccccagcccccacatgtcccaccctgagcttgctaggccttccagggcctcggtccccacatctgtgttgggagagaggagacagttccttctttagggaatgggggtcatagagatatcttcactctctagcttgttttcttctttctgattgtagctcagctccttttcttttcttctctcttcttcctgcctttaaccattcttccatgaaacactcaagtgggagagtttggttgtttgacaaaaaatggggagggtgggtagggaggaagatggagtttctttgttttctaattccgccctacttcgtttcctataaggggaccaggaacacttttcactggtcatcgtggggcttctcatcccctaaaggccatattaccccaacttctagttgtcagctatccttgtcaaaatttcctaattttgatacttatatcccacttattcactaatcccagatcaagcttcacttcctccaaaaagtctttttcaactatgtcagccttcacagagcaactgtcattctttaggaaaaatcaaaatttagcttgtaatgatatatgaattgcacatgcacgctaatttatactctccctcctgatttaacaatccttaaggaacagtctcccttgtatcctgcgggcattctggttcgatactaggcacagtgttgattgcctgtttgatacctgcttaaaacagaaaatcgacttccaagttctgcgcactggtgtttgcatgaggacatgagccccattccttgaattcctacaatgtcccaagtgctgagctgggcactggccatgccaaaaacacataaacacattctgtccagagagtgcttacctcttcttcctgagaagatggccagctcacttacacaatgagttcattttcgtcatggagatcatgaacagagggtgcattccagctgagctagtacttcctgcccctcaaagctcagctcaaagtgagtttccttctgtggccttcctcaggccatggaaccttaagtttcttcatttttttccctaagacaatgaaaagaagaatgctacagtaattaatgaaagtctcatgagtgatctcttgcatctatttccagtggatagttgggtgtttctgactggcaagcaattctcctgcagaccaaattcagggacccaggctccttccacttgtggctctgccacctgcaaaggccttggagtgacctgcatccagagggcaatggcagggtcacattatgacttttatggctccagtgactcttgccttcatgggctccttcttccatgcaaaaaattaaaaattatattttataactctattggtataaagatgactacattgtatataaatatatttttttggccaaaaagtctattttgttatcttgattttaaagaaatagaaacatttccatgaggccttaaaactcttgtggacctgtgctcatctttgtctgtgcttacctcccagtctgacccctgcggtgctcatcgaccctatgcccttggatccagcatgtgccaccttgctttgccttcttggcatgttcctgttagcctccccagacagacagcaagatcttgggtcttttgctagctccctagcacattacaccaagccttgcctagggcgagggtctcccagtctgattcctgaatttgaccagtaggagagctatctgccaaccagaaacaccgagttcccaactggaaatagattcaagagataatctcataagacctcagtcaattactatagcattcttcatttcactatcttaggaaaaatgaaaaaacttacagttacacagtctgagggaggacacagctatgtatgattgtgcccgttctgcaaatcactaaccctcagtttcctcatctgtaaaatggagggcaagaactgaatctccctcatggtactgcgtgaagaagaaaatagatgattcatgcaatgtgcttaaaatagtatctggcatgttgtaagcactaaataaaggttaacctttttattattatgacaatacaacaatgattcatatttatgaaatacttgcgtttttctaaaaactgccacaagatgataacatagctataatcataatgtctcattgcagccaaaacttgtttatgggaaatgttgaggttgaatggaaatgttaaagacagatgtggatttaaatctcagctttgccacttgccagcttagtgacatgtgatacttacttaatttctctgagtgtcttagtctgtttgggctgctataacaagatgtcctaaactagctggcatataaaaaacagaaacatatttctgatagttctagatgccaggaagtccaagatccaggtaccagcagttgcggtgtctggtgaggtccactttctggttcatagaaggctccttctatccgtgtcctcacaaggtggaagggacaagacagcgctctggggtttttctttcttttctttcttttttttttcttttttagcaacaagaatgctcaatttatttattttttcttagcaacaggaatgcccagtcttgggctttttccataaagacacgaatcccaaacatcagcgctctgcccttgtgacctactcacttcccaaaggtctcacttcctagtactattacattggtgattaggtttcaacatacaaatttggggaggggtggacacaaacattcagatcatagcactgagactctgtcttcttacttgtttttattttactttattttattattatttttttgagacagggtctcactctttcacccaggctggggtgcagtggcgtgatcatggctcactgccccctcaactttctgggctccagcaaccctcccacctcaacctcctgagtagctgggaccacaggcatgtgccaccatgcctggataatttttatatttttggtagagacagggttttaccatgctgcccaggctggtctcaaactcctgagctcaagcgatctacctacctgggcctcccagggtgctaagattacaggtatgagccactgcacctggcctttcttatttgtaaaatcagataataataccacttacttcacaagtattaagaaactgttcttggagtgcttgacaccagtctgccttttcttttttttcttttgtcgagaataaagatgactgtctaaacaaatacctcctactcatccatggttacgaaagcttcaagtcctcattagagacaaactttggtgttaggctcaagaatgctagctcccttcccttttccctatccctgttaaaataaaaaacactacacacctagaaggataatacatgagtccttcctcagtcattaacaccttaacctaaatgtgcttcttgtctccagagagcaagctctatcagctggggaaagaagggagggtttaagaatgtagggcagaggcacaggtctgtgatgccgaggactgattttgtttctgttaattttatttttctgtgatactggcattcgcataatatgacaacattttctggattttagaggatcacattctctgtcgaactctccttgattaaatgaagtcacagggtgaatatttcaattatttcaagcctttgtggtcagtgatctagtattcaattgacctgaacactgaaaacaatcatcatgcctatggctatttgctagggacacgtgataaccacatgcaggaattctgggtaagagcccaggacctcattccaaccctgcctttcccaaatacctgccctgtgagccaaatcgcttaatcttaggattcttttgtttcttctttataattttaaaaagcacagtacctgctttataaggttttatgcatgagatggtgcccatcaagtgtatagtggctggtgtgtgataattttgtaaaagcgtcacatggcagtacatcagagccacatgacatacatgactgctgggagctgggaaacacactaggagcagtggtgccttccagttgtcaccagagcaggcactgaacctccactcacaatgctcgggagactcacctaatgccaaagccagggtctagataaatcctgcttgacacaagaccatataaagagagagagaaatataggctgacaaaaagtggctacaaagcaaggcaaattcaagtggctactggtggcgtgtataaaacagaactgccctgggaaaggaacaatcaaaaaacaagatggtgcctggggaactttctcaaaagtgaggaaacaataagctatgtgtgctccttaaagcaaagatatggcaaagatcccaatccatctcatatttttaataaatatgtcattctaatagaattttccttggtacttaaaattagattataaattttacccttaggaaaaaatatagttaggaaaaagaaggatgattgaatgaatgacgaaaggaaaaataacaagtgaatagtcggtaatatgataatatgataacatgcttaatcacctctcaaagaaatacagctccaagttacataatcctggattccacatctggaaacaaggagcactccctgtatttggagtttattataaatataggcagaaaggctgcaatggaattcagaaggacaacccagtagaaaattgaaacctggaaaaaaaaatcagcaattccataacacatcacttatagacagccccacgctgcccctggtaagtttttgcagaagaacatgaaaatccttagctaaggtacaaacaagccaagtagaggtcaacacatttgggaaatagtggctccacactcctaaatgtcaagggtgtgtgtctggggggtgggggtgggtggggaaggattgtggtatttcagggagaaggaatgtcggatgtttgaagacagcactaagtgtatattagagtgagcactgtcctgggcctctaatggactccattctgagatctgtgtcagaactgtcaataacccagcctagcccaaaactgttaatgtatcacctcccacccagagctgaccctgcttctcagattgcttccaggcaggtcccctgcagagaaagccgaaggatgggtagacacacaggactggtattggaagagatgcttcatggtttatttcttctgcacctgccctcaaagcttgaaggcagctcttgaaacccttatttccaagaaaggggaggaacttggctgtggtattatgatgctccctaagatcttgcagtctgaaagctggcttggagccttgttttcttctgccatctccagaatcccaaatgtactaatcaagactcccttgttcgttctaggataacacatgactggaccacagggaaataaatggccatgaaaagatgacaccctgaagccagacaatattctcctaacaaagaaaggggaagagttaacagagggttaaaccaaagacggtttggctagagagacagcatagttgaaccttctcatcagttgtggctgtaacaagaatttgcaaagatgaaggtttatttaaggaattaaccaagaaataagctgttctacccacagtcatcacagctgccaaaactcaaattattttcttaccctgagatgatcctaggggaaagcatgattcaagttctaccagagtgtcaactactccctctgggcttgtgttaactcttttggaatattaaaattgtttctgtagcctgccagaacaaagctgggttgttgcagtagcctcccagatgaggttagggtcattgcgggcgggagggagtctttctcaccttttttctttttatcttatatacacaaagttaaatgactggatgaaagccccagatactggtctgtagaagtgtctttgttctcatggatgcactgttacttcctggactttgggggactgaggtcttttatagttaaagaaatatacttaggagattggcctggttggggctctgccatcacagtctctggagctgtaacctaatcacatatccttggcagcaaaggcaagatcccctgctgacttgtcaaactctcatatggatgttaagaagattaagataatagcatgcctaacatagctaataagagagatttaaaacaattggcagaaacagattgagttatgaaatgcttattatggatgattctgtgtcacaaaaacagcatatagggtcagcttaatttcacacacaagtaaggggagaagagatgccaatgatgacgaggcagagagagagagagaaggagagagagaaagagagagagcctgctatgccatggccagtgctcaagtgggcagactgatactgagctctgctgggattgcccagtaccaaccccctgcccacaccccaccactgatcatggccagtttggaaagggtgtagaggtcacggaagtgtcaggtcacacccaatgtcctagacactggaggaggtacatctgtgtccaaatatcctaaatagattttcctaaatttgagaatagtcacttcaatctttcttctttccagcctgggtagatcagccacatgccaattgtcttcttgttttctttccaggacaagaagaacatagtttcactcgcagggaatgaaggacccttttgggccttggggggaacacgctgcatgcagcttcctttccatccttgcatcttctttgctgtctagtgctccttgtcatggtctctggggctgtcagcagccaccgcccctgcgctgtgggctccctgccctgtggagtcctgtgctccaggctggctcccacctctccctaagagacacctgggcctggccgtgtggtttgtaggctggagtggggacagaggcctgctggtctcaccccacatttctcatccatttagaggaaggagccatctgagaatccagggacgctcctctggcccaccagccttctcttccccctcccaatctccccttcctttcacaagggaagggaggagattcggtttgcagcgagaaatgttgaagttgggaacgaagtctttggagtggattagccctttgatcttcaggtgggatctccaggtgggacgctcatggtgagaacaagcagcaggctgctctcctgccttgctggtgaaaccctgtcccagacgcctgagaaagtgacctggcaacatcgttaaaattgcaagcacgcattccctttaaaccagaaatccccctcttaggaatctctcccatagaagtaaaagcatctaggtataaagggacctctgtaaacaatgtgcactctttgcggaggcaaaagtctggaaactagataagtatccttgatagaggaaaggaggaatacaatagactacagacaccgttcagagaaaacttaatgaaaacactggcagacacaaatcaggttgtggacatgtgttttcttgggagaaattaaggaagctgaagatggtgtatggcacaagagatgaagaggggttagtcgctcccaacaaacaaaaaagaaaagaaaatgagaaaaatgatgacactttaacagttcaagcagattgtctagggcagggaagtagactgagaaacaggctctgggaagtagactctgagacggaggtttgcctgcaggaggatgtgccctccttgtcacacctgtgggggagggaggcaagcaggatggggtggaaggagaagctgggctgccatgcagtcaggacaaaagcctcagcccatcccggggaaggcagcattgctctggacagctgcccagtcattggatgttggctgcctgcaggaagaaggagactctcatttgcagtgggcagccaccaggagtgagacacagttgggagctgccaggcattggccctcccagcaccatagggaagggacacagaaggcacactgcagcgcccattgcacgggtgcacgatcacatgtatgtatattagtaaagttatagatatacgtgtgtgtggaaatcgataaaggatgagagtaggcagaagaaaagagggtctctgattctcagagtataaaatttatttctaacactggtgagtctgaagcctcactggaccccattccagtgggaaacagacaagactctcagcctgggcagttacagcagtgacactggccggatgatttcccttgacctcgccacatggaagccatgcaacccagccccccatcgtcttagctcctgagaactctgactgccttctatttttgaatgggttgggaatagaaccaagagataaattttgtctcccttttgcttgtcagggttgggtaccttgaatatgggttcaaactggaaccaaaaataaaattcaaagtaaacacctcagaaggacacccagctatctccatggcagaactttgcatagggtgctggaaaattcaggcaactgctctgacccagcacaaactaagaagctcagcaatgactcagtcactcctcttgagagcaattaagctgctgtaaaacatgtaggaacctgataagtagacatacaatcagtccctaaatcccaccttctcctagcaccatattgctaaggcaaagcagagacaattcattcggcttgcatattttcctcaagactgtctttcatacttctctgaatgagattttgtttctatcagcaagtgtttaagaaactatggagaggaagaggaagctggcatatggcttcaaaataacttatttctgttgacatgaaaagaaagccttttatatttcaataggatatcttcatgtatttagcattgttctggaaataatagttaatgcaatgagccaaggaaaaggtgagttatatgtattgagaaggaggaggagcagagttagtaaacattgataatttttgtatgtctggataactcaaaagttattagctggaaaaagttattagtagtatgtaataagaaagcaggaaggtagctgggtaaaggttaaatatattaaaatctatagctttcttatatgccagcattaattgtaattagaatgtaaatattctactcacagtagcaacaaaactataaaataccaagggatacatttaataagcaatgtatacaataaacaatagagaaagctacaaagatgaactgacttgaaagaagtaatacattctgggatcgaagtctttaggttgtgaagatatcagttttatccattctgatttataaattaacagcatttcaacaaagagtttacttagaactagacaaaataattctaaattttacctggaagaataattataggtgaaaaactaaaatgagatgggtggaaagggggagcttttcctatttgatattaggatgtgtttttaagttgcattcatctacagataggaagaccaaaacacaaatcaggacatctgctgattattcagccatttctgatgtttccagacatggaaattaacattctctctttcctcagttgaccatagattctcatgagtgttatttagccttgtagagcacagcaatctccacgtagatcccaccagcccagaagagccatcagcccctgcagtcagatagttcttcactttggacctgtattcctctgacaatactgagtgcatctccaagggcagagtatcaaagcatgtcctctggctgggtctacaggacaccaacatctggcagagaactgacccatccagttggaactctggactttttccacttccaccttttgctggataggtaaaacatacagacttctattttaattcttcacttgtttcctgggatttttgatgccacatataccaagctctcaaatcatcgtgtaaagggccagtttttctcaaatccattgtgcaccatgatgttttttaagtgtatgaaaaataaatcataaacaatgaaattaaaaagaaagccaatgtcaagcaaatacaagcccctatttttattactacatttcatagaaatcaagttactctgtcatgttgccgtatatgtccttaaacacttattttctttggtggcctgacccttatcaactgactgcaccattatataactcatcacaagggaactggctactactttagctagcaattctttatgccttgtgatctaagtaacaagacaatcttacatttttataacacttaactttttgtagtgtgcaaattcttttcctctccaacaacactattttgaggtagttggggcagtttttacaaacccaatttctcacatagtgtattagtctgttctcaaactgctagaaggacatacccaagactgggtaatttataaaggaaagaggtttaattgactcatagttccgtagagctggggaggcctcaggaaacttacagttatgctgaaaggggaagcaaacacatccttcttcacagcgcagcaggagagagaagaatgagggccaagcgaagggagaagccccttataaaaccatcagatcttgtgagaacttactatcacgagaatagcatgggggaaactgcccccacgattcaattaccttccacttgtccctcccacgacacatgggaattatgggaactacaattcaaggtgagatttgggtggggatatactcaaactatgtcaggtaggaaatgcaattcctcatagagatattcagtgacatggtcaaaggggttactgacaaagctggaatgcaccctggaatgccctccctgattcattattttttgttatttccacttctttccccctgcttttccaaagcatttttattcatagttaagtcatgattcagggccccagggtgaggatcaccatgtacccaggtttccctttgcctgggagaaggatgaaggacataggaggggtaagatgcagccagttcagatctttccaggaaatgtgcctttagcccagctgtcatcctagactgaaacccaggagcagggcagaagaacttgtacacacactggtatcattcacacatagagacatcacacccttcagcggttgttgccttctcacagaggtggaagtccaggaagttctgccagcagttcctagtctggttggggaagcgtctgtcaaaaggggcagtcttgtagttcttgattttggtcttcatgtcttttgccaaggtgctgacttctaaagatgctcatgatgcagctggtagctcagtgtgaccctcagcaaagacatcaactttggacctcattccactctttaatgaatctgtttatgtctcagttaatggagctactgatgactgactcagtgagtctaatcccatgaccctgactgacaaagcattgtaaatgctaatcctgcaaaagtcccttctactgttatctacaccgtgaagagaaaacccaccaaactgaacaatgatgatgttcttacacagcagcgctgcattaggaagaaaatttcaaataatccatcacctagtgtgaatatttccacaaaacagcaaatttcactaaaaactctcattaaacactttaagaagagacgtgtagcgagttatttaggctacataaaccaaaaccaaagtgatattgttggtctggtagttctttcttaaaactgcaggtaacacatataagagcaaataagtagcgtcttataggccaagtttacaaaaataaactacaaagagatgtgagaaattttaaacaaaatctctgctcattgttcagaaggagattctcttctctgtgctcttcaggaggggccagcagtggtatttgggctgagtggcaagtgaaggggagtgcttaggtcccttcagactgtgtgccagtgaatgcagttccaaagagctgagagaagggcaaacgaccagcccaggaaggcagcatagtacaggggaaagcccttggttccagaatccaagggttttggtttgaatctcagctttgccacttcctaactgggtaatgggccctcacctcactctgcctaatagaactgtgattactaaacaaaggtagatatacaatggctagtatataagtgctgagagatatttgtccttgtcaatagaaaaaaaaaaagcatatagaattcaccttcctctaccaggcatgtgcctggacctcttcaggctttttaaaaaagctttttaaatttatttttgtctgacattgattatgtgggataaaatatctccaagtgcggtgcagagtctatatgaagaagcacagataggaagagaagtagtcacattaaagtcaaattaagagtcctattaaagtctacaatagccaggctgggcatggcaactcacaccggtaatcccagcactttgggaggctgaggagggcagatcacttgaggccaggagtttgagaccagcccagccaacacagtgaaaccccatctctattaaaaacacaaaaattagccaggtatggtggtgcatgcctataatcctagctacttgggaggctgaggcacaagaatcgcttgagcctgggaggtggaagttgcagtgagccaagatggcaccattgcactccagcctgggtgacagagagagactctgtctcaaaaaaaaaaaaaaagtgtacagtagccattgggctagatagcctgaggcctaaccggtgcccacagtggggatgtgttatagcacaaggaaaaaagctttgctttatgagagaattttgcaagggctattctgacacacacctgagtgagctgacatgtttggagaaggctcaatgagtagaagctcagtacctcccatgtatgctcagaatgttcccacttttactgcctttgattcctatctcaatacattactttagtctctaccaaagtaatacggaagacagaattagaattgtcttttagtgattgtatgcagtgcaatgtacaaccaggacaattgtgttgtttttccggcttgagttgctccagttggctgtctataccaatcacaagacttgtatttctcaggactgtgcaaagttaagccaagtagttgagtacaaaccaggacaggcgtttaatgatacagatgttctacaacatgttttctttttttcaggcaccagaaatctatgtggttactttctttagtttataagaccacatgtaagtactttggacaattgatgtatttttcctttttacattcagatatttaacaaagcaaggcacaggtctaggctctgtatgaatctatatctgaagaagccaagttggagcagcttacaagcagatcccagtcactgacaccaccttccgaggcttagtgatgagtagaaaatccagacccttcaccccgctgctcatctgaaatagaggacaataactggaatctctatgctctccaataatgcaggacttgactttgagtctcttcaatttaattgaacaaatatttattcaggacttactactgtgcttaggccctgaggattccaagctgataagactgattcaggttaggcctatggaatacaatttagagcttacaagatgatcacctaagccactttcatcattcagctggtgaagaactgagccctggagagaaggaagcttcccaatggcacaaagcaagggagaaccagggtcattcaaaaatttgaaatggtaaaaatgtagatgccattactatcaaaaaagtggtagaagataaaggtactgtgtgcaagtccctattctgtagctttggccttagatgtggatccattccttacctggacacagaggaaaggcctccctccttaatgtctgcatagggccaccccctcaggtaaaccaccagtgtgtcctctaatgtgtcccctcagctctggaaccagagttaaggccacctgaccctcaccatgtgactagctctatcctggacaagtcagatattaaacccagtataatgaaaaccaggtctttacattagagatttttatttcaatagatatcaagatagacttgcaagcaaatttgtgtatttaaagcatatgatataatgatggactatgcatgctaattattagaaagtaataagggtgctagttaagtggtgcttcacttctctgtgaagaattttttttttttttttttttgagatggagcctcgatctacgcccaggctggagtgcagtggtgcaatcttggctcactgcaacctccgcctcccgggttcaagtgattctcctgcctcagcctcctaagtagctgggactacaggctcctgccacaacgcccagctcattttttgtgtctttagtagagacggggtttcactgtgttagccaggatggtctcgatctcctgaccttgtgatccacctgcctcggccccccaaagtgctgggattacaggcgtgagccaccatgcccggcctgaagaagttttttgacttcctaaacttcaaactggaaaaccagcctcctctgactgtacctgtacaatgattttggtcctttattgggcttaattacatgctagtctccaccttgaagtcagggtctgttcctgtctggcgcctggtagactctcaatgtttcttgaataaagtaaataaaagatattttgagatcttagtccactctggggtggcttcccagaagagaaaagctgggatttattttaagaaatggaagtaatttggcggaaggaggcatatttcttccttagtgccctcaccaagcctagaaaataggagcaggtcttggggtgggatggtgggaagggtgtgtggggaggaaaggcacaaactatgtgattcccctatggctagagagaagctctcggaggcaggctaactctgccaaggtcaaggagcaaacaggaatggaagccttgaccctcggtccagcctcacaccacatgttctctataggagacacctttgtacggagctttgcactgaccttgagaaataatttccatctggaattctgggtgaatcacaggaaggcaatctgcaatttctcaagtttgcacttggctggggttgttgaatctatgttgtaacccttatgaaacactattgctcaagaacattcgaatggatgcaacatttgtaaattaaaagcctgctgctttaattcccttccaatggacacagttagacatatacagaagtcacaactggatgcagctggaggtttgactttgagaggatgggagactggaaatccctgggcatttggtcagcacagtagcagagtgctggggtttgggaaagtagcggttgggtaggagaaggtgttgcatgcaatatttttctttctggtatttgtcccgggagatccatattgacacctgaactttgtgacacagtcgagccctgctccactggcttctatacaaacaacatgatgcaaaccagctggggccaaagcagttaccatggaaaccctagactttggtttggaaagtaaaagtaaaagacatttatgatgaccacagcagtggtttgtaccaatgcacttcttgggaagtttcttttttatcctgaactttagcgttctttttttttttttcttgccctgtggaatttggcaaaagaaaaatttaaaatcagattggaattattaccttccccattaaatagctaaaacaggaagtcttgatttattcaaaccatatttgctaaagacaaatttaactctaaatggagaaaccgcttaaaggtcaagttttgtcttggatactttgaaagagttgctaagcatttttgtcccctatggaggctgggttgacaccaggaagtgttatttgtgttatttcccctcaaacatttttccacctctcagtaatgacaggagaattatggctatagagagcaaacacagccttatgtgggcatgatcacagttgtagcaagccagtcatgatagcaggaataggctggttgcatgagtgcactgggtgaagactacagaggacattaagggcaccagagggaacaggttcaatttctactctgtcacttacttgctgcatgatcctgggccagttacttaaccaccctctaccacagtttcctcaggttggaaatgagaatcaaaatgcccaactgcccccaaatgttcacatggattcaatgaaataaagcacataaagcataaactgaaatccaaatggaaagcaatcacaaaaagaatccagtggaagggaagtgggaagtagcaggcagatcacgctgacaggttggcttcaagtgaccgttccaatctcagaggaccacagtctcaaggccacctacagtttcctttaccacccactgtctgagccaccaaagcctaccccacccttgcacctcctttcttactcccttctaactgtgaaggcatcgggctttcccagatatcctttgcattcaaatcctctcaaccactgcctgcagattcccctccttctgtactcatttttcttttcttggaaaaaaacaaaaacaaaattggacccttggtggagcccttgatggcgacagcacaatctttcatccctttgctttgtcctctcaggtcctggctctgttcctcacctccacttttatttccacatcctccatgacaagcctcctgtccctaacattcagctgaaactgttcctagatcccaaactcctaccctagcacaagagaaagctggtggcattcctatttagtgacatctcttcccaactctgcatcagctttgataggtcacaaatgacctcagattactaaacgctattttttttctccttttctttccccttgacttctctgctgcatttgatattggcgccactttctcttcactaaaattctctcttctttttgttgccaggattttatgctgtggtgagtctcccacttttccaaaacgttgtgcaagttctgcttgttttttcttctgcctactgatgccaacatattctaacattcagccctccttaggagatgacccattcccttagctttgctattttctattcccatgactctcatctcaagagctcttcttcaccaaatgccaattatttctgctgatctctaggtcaaccctgtccaacagaacattctgagaggatggaaatgttctctgcctgggctgttgaatgcagtggacattagccatatggagctatggagtacttgaaatgcagttagcctgactgcaaaactgaatttttaattttatctaatttcaatttcaatttaatttattacatgtggctagaggctaccatattggacagcatagttccagatagtttcacttaaacaccatcatttcaggcaaaatatgatcaatactaaaggttttctggaaccaactcctctcccagcctctctgtctatggacaactaatccctactgcatgcaaagctcaaaagcctcttttattaattccactctgattcctcagacgcagtctctgattcccattgacctgccttgaaatatccctgttctctccccgaccttctgtattttactgccacacccctgagcaggtcctcattcaaacctaaacagccagcctgaatctctcacttcaacacaccttgcgatcactgcagaccggatcttattctaacactgctctgcaatgttgcttccctgcctcaaacccccagtggctccccacttcctctgatttcatggccaaaacctttgtctggttttcaaaaagacacccagaataatatcatccctggtctgggtcaataatattgtcccaccaagtctggataataatattgtcccaccaagtctggttttccatgactctctctctccctctctctctttctacacacacacacacacacacacacacacacacacacacacaccactcaaggattatctcacaagctcatgaatgtgctgtgttcactcctgtcttggagcttctattggcttttcaaatccgctattggcttttcaaattctacctttcaagacccagttaaagactccttccctctatggaaacttccctaattaagacctgcctggcatatctcccctctggattcctagaccatttataatgagtgttatcttgtcctgatgactattgtttcaagtgtgctatccttttccccagattagacttgaagaaagtggctcttcttcttcctgacctccagaagacttagctcagaaccgagcccgcagcagatgctcagtgctttgtgaacatgtcttgattcatcagcaagtgcaggataagaactggatgtgacaacatctgagagctcagtgaacattagactcgccttgttaataatttactccctttgtcccctagtttcctgctcatccctctatttctcctggctcttttcagcttcaattcctctcatttgtccacttcttccctttgtccagtaaaccacatgggctgatcagggttggagtagagagtgtaggattgtctattttctcttggaactgatggccatggtgaacaccttgcttgccatatgatcaacatggctctatgaggcagttaaaactatgtagacaaaattttttttgtcagataaaatgaggataaaaatacctcctcatcaacatatagaggaactatggaattaaatgaataatgagtaatgggctaagaatataggattggatgtaccagaatcacagtgcaactgcctcatggaaaagctgggcattttcatcttaagggatgatccagaagggcaaagtttaaaacaaaggaactgattcaagtgcaatattttacattgtgtaaatatctgaaggaattcacaaacggaccacaatggctgcagagacacagtggtaaagtgcttaataaattggcgaacacgtgttgtgccataaatgttagtgcatgaagcaagttatgattatttgtttccctttgtgtttttctaatcaaagatttaaaaatcatgggagttttgagcatcatgagataacaagtattgtgatacaggtccaccattccttttccaaaaactttggtattagatgtgttttggaaatcaggatttttcagattttataaaggtcatctggatcatatgttgtatattgtatactactaccagtgggatatgggtcagcaccctacaatcaaacacagaaatatttctgcaacacaacgtgtaaaatataaaatctacaaatggactcacctgagttcagattgagttcactgccaaatgagttctgataaggtcagattttggccccaaattattaatcgagaacttgcaattttcagagcttttgaacttaggaatacagacattgtgtacctgtcctattctacatcattttctttaaaaagaggtagtctttttgaaagtttctattaaacttttagagatgtaaaaaatagtgggtagtaattacagaacttactacaaagctacagtaatcaaaacagtgtggtactgtcataaggataaaggacatatgaaatgtggaatacaattccatttgatggaatagaatttagactccagaaatgaactcatttatctatgatcagttgaatttcgacaagggtgccaagaccactcagtgggagaaagaataatttcttcaatagatgatgcttggacaattggatttctacaagcaaaagaatgaaattggaagcttacctcctatcatgtataaaaattaactcaaaatggatcaaggacctaagtgtaactataactcttaggagaaactataactcttaggagaaaacataaggatacatttttgcaactttgtcaggggtgttcaatcttttggcttccctggaccacagtggaagaagaagagttgtcttgggacacatataaaatacactaaaactaacaatagctgatgagctttaaaaaattggaaaaaatcataatgttttaagaaagtttatgaatttttattgggctgcattcaaagccgtcctggccatgggttggacaagcttgaattagacaatgactccttagatatatgacaccaagaacacatgcaacaaaagaaaaagtagataaattggatgtcataaaaattaaagacagctgtccaccaaaggatactatcaagaatgtgaaagggcaacccacgaatgaaaatatttgcagatcaattatctgaccagggtctggcatccagaatatattaataacccctgcaactcaacaataaaaagacaaataacccaattaaaaaatgggcaaaggatgtgaatagatataactccaaagaagttacatgaatagccaaacatgcatatgaaaagacactcagcattattagtcattagggaaatgcaaagcaacatcactagagatactatttcacacccactaggatggacatcattttaaaaaatgacaagtaatggtgaggatgtagagaaactagagccctcaaacattgctggtgggtatgtaaactggggcgtttgctgtgaaaaacaatttggcagttccttaattagctaaacgtagaagttccatatggccgagcaattcaactcctaggggtatacctaaaagaactgaaaactggtactcaaacaaaaacttgtacatggatgttcatagcaatgctattcatagtggtcacaaggcagaaataacttaaatgaccctcaatggagcaacagataaataaaatatggtacattcatacaaataaatagtattcagtcatacaaaaggaatgaagtcctgaaacataccataacatggatgaagcttgataacattatgcaaaatgaagaggtatacacaaaaggtcacatatatgatcccattcatatgcagtatcaggaatcagcacatccatacagattgatggctgccaggcacttggggagtggggaatgccgagtgattgctaatgggacccagatttcattctggggtcatgaagtgctttggaactagatagtggtgatagttggataacattgcgaatgtattaaatgctacagaattttacaatttaagatggttaaaattgtgaattttacgttatgtgaatttaattacaattaaaacaaagtgagtagacaaatattgcctctttggggacctcaaggcatctggagacctcagggtttgtttggttcatgtgttttgttttgttttgaatcactagctaagatgttggcaacacagtaaacaaaagctgaacaataataataattgatgtctgctttaaatgtgctgtttctgatgtatttttgtaaatttcaggaattcctgtagcataaaccagagtttgttaatcttggcactattgccattttgggctggttaattctctgttgtgggggctgtcctgtggttgtggaacattcggcagcacccctggtctaacccacacaatgccagcagcatctcccaccccaattgtgacactatgacagaaagagatcttgggccaggcgcagtggctcatgcctgtaatcctagcactttgggaggccgaggtgggtggatcacttgaggtcaggagttcgagaccagcctggccaacatggagaaaccctgtctctactaaaaacatacaaaaacttagccaggcgtggtggcaggcacctgtaatcccacccacttaagaggctgaggcagggcaatcacttgaacccaggaggcagaggttgcagtgagccgcgatcgcgccattgcactccagcctgggtaacagtgagacatcgtctcaaaaaacgaaacaaaaattattcacaatagcaaagacttggaaccaacccaaatgtccaacaatgatagactggattaagaaaatatggcacatatacaccatggaatactatgcagtcataaaaaatgatgagttcatgtcctttgtagggacatggatgaaattggaaatcatcattctcaggaaactatcgcaagaacaaaaaaccaaacactgcatattctcactcatagctgggaattgaacactgagaacacatggacacaggaaggggaacatcacactctggggactgtcgtggggtggggggaacagggagggatagcattgggagatatacctaatgctagatgacgagttagtgggtacagcgcaccagcatggcacatgtatacatatgtaactaacctgcacattgtgcacatgtaccctaaaacttaaagtataataataataaataaaaaaaagaaacaaaacaaaagaaaaacactaacaaaaacaaaaacaaacaaaaagaaaaacgtctccagaccttgccaagtgcctcctggaggtcaacatcacccccgattgagaactactaatgtgacctctttaggaaaagtttattatcctgggattttttcctctcctaaagtttctttttaaaaacccatttctgagattgttctttagtaatttccaaatgacagcaaactcatgaaacaaaacaacatgaaaattccaggtaaatgtccaaaacctttttcattaagaggaactaaactacgcagtccacttgtagacagtaggtttctcactggcaacgaatgccctggcaataagctaaatgtggatagcacataaaaaaagtgaatgtgcaatgttcccttttcaaaccctttttgggcaaagacgactgctctgccagcattccagtataatgacagctcatgtgccctttgtcaaccttgcctccttctcctttgaaaatacaaaccacacttcttcccaaacttcttctgataccatttaatgagtctgggatcagacactgttagcacagagagcaacctgtgctccagatccccctcagcagccgctgccagcaggaagggagggctgagtgttcaggacgcagggttccctggctgcttcaccagcgcagtgctgcctttatccattttatgtcttggatttctgagtgggatttattttgcacaaagagttctgaagctgagaagtttgaaagccactggctcaacccaagcccctctcctacagatgaggacaccagagtgcagagcaaagggcaggaccacgtgtgattccagggcttttaactgtagacaggcccctttcctctgttacagggaaggcagccaggcagctcctgcaagatgtcactaatcccttgcgtgcctcagtttccttatctctacatgagcatagcaacctccatcttcctggctacttctgggatttaaattagacacagtaagtgccatgcaagtaccactaatatggatggaaagtttgtgtcctccccaaatccacatgttgaaaccctaaccaccagtgtgatggtgttaggaggtggggcctttgggaggtgattaggactagatgatgtcacgagggtgaaccctcataatgagattcatgcccttatacaaagaggaaggtaccagagagctctctctctctctctcttcatcaggtgagaatgcagggagaaggcaaccatctgtgacctagcaggagaaccctcaccaagagcctgacaatgctagaaccctgatctcagacttccagcctccagagctctgagaaatcaatgtcagctgcctaagctgcccagtctatacctgcccaggtattccattatggcagcctgagctgacaagtctaccgcttgacatcacacacatcctcaggtgtgtgaatggtttcacttcttctttcctaggaaaagagtcattaaactctacacgtttcacacaatcctcttgtgatcacagccacaagggaaagctcagcttactgaactgtgtagggattctgttactgtctcactgcacagttgtcttcctctaactgttgagaatcaaaggctataggaggatgggtctgctttgtcttgaaccacaaacttctgaaggactgaaggagagaatcgcactgcgggtgacccacttctgcttcacactctgatatccccatgaaaaggagcctgcacacaggcagtgaattccagacggagctgaactctcaggtcctctttctaaattctcaatctatctaaaagaatacacatacaggtgaaattttacctccctgctaaaaaccttagggaaagccaaagttcataagccagaatctctgagaagtttcttgaaactatagtttggttaggaccagcctgaataaaaaactgatgaatcctcggttcacatcaacaaaagacgggaaagacggaatggctccagtagcttctcaggaatagccccaggggcttgagagagcagaaactgcgacacacacaggatcagggccagcttgtcaaaggtaaatctcaatgcttacatccaggcaggatgggaaggaccctgaactttcccaggcaaggtcagcagacaaaggaggttctctacaacaggtgcccaggcggtcagtcatgccacccggaggagagggcactacacaccctgcaccaaacagacaagagaaacagcctttgctgtgcaaaatcaaaacatgttacttccatctcttgaaggataaagagttctgtactctggcagattcgaatcacaacaaagacaatccatttccttctccccttaatctggatctgaaagatttgaagaggaacctacccagtttcaaacaaagcccatttcaaattttaataccaggtcaccctctatgaggttgaagaaaaagagaaaaagtactgttcctatgaaaagcttcagctattcaatagaggagattgatcccaggaatcagagcaagtgtacacctttaaaatggtgatgcggaggatgatctctaaattgtattcaaacaagacttaagcagctattaggctcacaaaacaagtgtagggggtgacgaagatggacagtgtgcccaccatatggagtgggatggagggaatatggagattgtgtattacaaaaaccaaataagtaaagtggaacatgaacttgagaaattcaaatggaaatttaaaaaaaaatagtaaaaaagtgactaatgagagagaaatgcaaaaacaaaaaacaaaaaacaaaaaaaaaacagggcaggtataggaattgaaattccaagaggaagatcagagcagaggacatcatcattaaaggaggctgcctttggctttagagcaaaaggtgcactggatctcaagcaatagcaatgaaaagttaccccaaacagaagtccccagtatatatactttttaatttaatagagaaaaaaattttataaacatcttagttgaaaaataaatacacaaagagagtacttgacaaaaaaacaataatcaaggggacctcacgtcatttatgaagcattaaatgccaagaaacaaagaagcaacaagagtattttgaaatgcaaaacaaacaaacaaaaaagaaaaacaaaaccctcacttgaattctatgtcacataagttgtctttcatgtgttaaggtttaggcctggaagggctgagaaaatgtgttttgcttatatcttttttgttgttgttgtcagagacaaagtgttgctctgttgcccaggatgcagtgcagtgtggaaatctcagttcactgcaacatctgcctcctgagttcaagtgattcttgtgcctcaggctcctgaatagctagaattacaggtgtgtgccaccacgcctaatttttgtacttttaatagagacggggtttcaccttgttggctaggcttgtctcaaactcctggcctcaagtgatccgcccacctcggcctcccaaattgctgggattacaggtgtgagtcactgcacatggcccttgcttatatctttataggtaaaattttgtttggtgctatagtcttctctaatataataataaatattttaaactttgtgggccatacagtctctgtagcatctacccaagtccaccactgtcgcatggaagcaccacagacaatatgtcaattacagggcatggccaacctagctggtagaactttactcacaaaagcaggccatgatttgccgacctctgttccatctgggagattaagaaaaatccagagcacaggagtgagtaagtcataatatataataggaggacaattggtaaactaaattatagagagatacaaaagacaggagaggcaatacaaaatttaatgaaaataatctagttttaaaatgcactattttattaactaaaagatagaggttttaaagagaagggaaaagaagagtgtgctaaacttctcaccttccatgggcaaaggtgggtggtggagtaacagagagaactgaaggtttaaacatgcttttgaaaaactagaaagttatgtctagtaaaattaaaaacaggagacaagctttccaaaccaccacagaattaaaaagcaaagaaaaaagttacccgttttacgaaagactgaaaatagtgaaaacgaaggaagcatagagccagaaagcatatgataagttgacaaaaatcacaccaaataatctgtcacaataaatgaaaattagttaaatccttattaaggacaaatacccatattagaaacatggattatgagaaatccatttgatgtgaagtacacaagctgctatataaaatggtgaacaaatgtgaataaaaatagattagagattgaaatattatttttttaaatgtgcatatccaggaaaaataattaaatagaacaaaaagtctatctttaaatgaagatattattgatttgatcttttatgcatgaagcaaaaacataaacatatataaagcaaaacttgttaaaaatgtaagaaatagtgggaagaaacctggtagcaaagggaaactttatcatacttctctcaatatttggcaagtaaagtatataatagataatggtaagataaataaagattaatggataaagaagatctggaaaacaccactattaatgtttagttaatatatacactaaagattaaatctattgtgtattaattattgattacatattaagtcattaagaaaatctcaataagtcccataagctaaaaattattgagctcacactctctgaccacaatgcattaaattagaaattacatttgagaaagtgggagataaaattaccaatgattttcaaatgaacaaacaacaacaacaacaacacaatgaatcctttcctgtctacacaggacaagggaaatattaaaagcaggaaggcagactgattggatgacagcactgcctacccaaacataagggaagaaactaaactttgcgtagaagcaaatgtacagcttggattgtttttaatcttagacaagaaagaattaaaatagatgaactaaacattctgggtaagctaatattgaaaagcaaaatataaccagaaaataaaagagagaaatctctagagattacattaatgtactgggaaagagattaaaatgactaataaattcaggacttggattctttgaaaaaaactaataaaatatacaggctttcagaaagtctgagcaaagacaaaaagaaagaagaaagatagcaaagaaataaaaagttacagaatttcatgtagaagtctatgctaaaaacttgaacctcaatgagaaggcaaatggaaaatacgaaaataaagattatcaaatctgacgatcagaacagaccactatccatggaagaaatagaaaccagtctcaaagaattgcatccataaaaggagctgggcccgaatgttttataggcaagtttttcaaaccttcaaggaacacataattcttacggtatttaagctgttacagtttatagaaaaaaaatgaaaagtgtcacaattcgctttatgaaattaacataaacgtgctaccaaaatgtaacaaagacagtgcattaacgtaaaacaatagactcatttcacacagaaacacagatgcaaatgagaagtgaaatatttcctgtgatacagcaacatgaataacggtgatgtcacctgattgagtagaatttaatccaagaatacatggaaaggttaataatatgaaataaaattttatcaaatcaatgtcaatgaaaaaagattatattgatggatatcaataaagcaaatgtttaatttaacaaaattaaaaattcatttttattgaataatattaaaaatgcaaacaaattaaaatacattttaaatctagatctgtatagttttgtaaactctagaaagatatttctttgatatgatggagtatatcaatctaaaaccaatggacagtgtcatatctgtcaaaatatcaaagcagcatttcccaacatcattgtttaatcaattttccaggagatgttagcagatgtgcttaaaactaaagtctaaacaacagttcaaaagtagtttgggaagtaaatggagtgacaaaatgaatccagagttttcttggcagaatgaatgtacaatagacaaaataattttgaaaaagaatattcatccaggccttaacctagagaatattaaaatgtattatgcaaccacagccattaaagtaatgtgacagcaatactagagcagagagacagataaatggaaaagaagcgagtgtattccaaaatagatccaaaattctttttaatataacaaatgtggttttccaaataagaaaggaaatgatggattatttgataagccttttgagactatctggctaaccatttcaaaataaatactgtgaggcataatctaccaaaatacaaacatgaattccaggtagattacaaatgatgctctaaaagaatgaggaggaaacagacttacattgtggaaggtctctctgagcatccctgagaaggcacattcaatgaaaaaacatgaaaatatttgactatataaatattttaaatgtctaaacatttgcaaaaaccataaaacaacaaaatgcaaataaccaagtggaaaagatagttttaaatatgtataaggattataatattttaaaatattcctcatctttattcttttcttagtaaacctctctctctctctgcctctctctctctctctgcctctctctctctctgctgtccacttggctttgctattccatagaaggtggatgccactctggaaaggaggaggagtgtcccctttagccagaacaaggaagaggaaagacttccctgtcttccctgagggactgtgagaaaggtggggaagaaggtagtggaaagaggcagttggcatttgttctgagccctctctctcaacaagagtggtaggaatgcctgaagattggctgggcacggtggtgcatgtctgtagttccaactactcaggaggctgagaagagaggatcacttgaacccagggttctaggctgcagtgagccatgattgtgccacttcactccagcctgggtgacacagcaagaccatgtctggaacaaaaaaatgcctgaagttaaagcggggcggggggggggagcaggcagaggtgctttctcccattctccattctgggtgtagtcagtcctttccatgagagccaccatacctgttaatgtggcagccagtgtggtggggtagagagtgtggtgtggaaggaacccaccaggctctctgtgccctgagactgggatggaaacattgttgagaatttggtgcaggaggttgtcaaagttgttcacagggctgcagggacaaagtgactccctggccaacagcaacagagccagtgtcactggagccaggaaacaatggagtcatagtcaaaccctctctgactactatgacatttgtaagcccctaggcgtggtcagtatcttagagggcagatctgaaaggccctgtgctgtggtctgaatgtttgtgccccacccccgaaattcctatgttggaatcctggcccccagtgtgatgatattaggagatggggcctttgggaggtgatgcagaaagaggccccagggagctgcctcactccttccaccaagtgagcacacagctagaaggtaccatccataaagatgaaggtaggtcttcttcagacactaaatctgttggtacattgagctcagacttccagcctcgaggattgtgagaaataaattcctgtttacaagccacccagtctatggcattttattatagcagcctgaatggactaggacaccaaggcatccaagagactgaatatgcaaagatgatgcataaattattggatttgaatgagtttattaaatttaactaaaagtgtgtgtgcatgcatgtgtgtgtgtgtgtgcatgtgagtgcatgcatatgtgtatttccatggaagtttgtagaaaagatcacatccgtttttggaaaataagctacatcttcttggcacatttgcatatagtgtgagaagactggcaacccaggatttgtgataaataagtaattatttatcttcaatgtataaaatgagcttaccgataaaaaaaaaaagacagaaaaactgctgtataaaaagtggccaaaaagcacagataggaaatttcacaagaggagaaatataagtgatggataaaaatataaaaagaaatgttcaaataagaacacatgacacggggaggggaacatcacacactggagcctgttgggggttggggggcaagaggagggagagcattaggacaaatacctaatgcatgccaggcttaaaacctagataatgggttgataggtaaagcaaaccacaatggcacatgtacacctatgtaacaaacctgcatattctgcacttgtatcccagaacttaaagaaaaaaataagaaaagaaaagaaacattcaaatagcgaagaaatagaaaacataaaaatgaaaagccactaggcaagtgtcaaactggcaaaccaaatagcagggctaaaatacagtaaacttgttagacaaagaaaatgccttagaaaactgtcctcatatccaccatgaaaccatgaggtgacagaacacagcaatgactttgttactaagtgactaaggattattactccatccaagtaataactcacttgtctatagcctgacttgaaagagtcagctattgttcaaagcattgttagagctcattgttgatgtcttctgagcctgcagcacgttcttttgaaaatgatggtaaatcttcattgacagatttgtcttgtggaaagagccaaaattaatttaaagccaagtctggttatactatttctgatcacgagaaagcttttctcataaatctaagctctgaaggcagtgacaaaagaggcattccagaacgatgtggcagctcacggaaataagttttttaaatggcacggtagaaggattgcacttggcaggatacagctccccttgtcctgcataaaggtctcccaactggtctatccacaatcttgttttcactaagcctttgataatcttgaaatgctgtataaactctatcatgtcattcctgctcatctttggataaaaacacaaacttgtataatggctataaagccttgtttagtctggttcttccctttccagcttcactggacaccagttatctcttggcctcttgtttctggccacagtggccttctagaaagtcattatggacattaagccagccccactaaagtcttcgcacgttctcttccctccctccccatttttgcctttaaacacctactcattcaatagatctggacttaatagtcaagccctccttcccagaaagacctttctaccctcccagtccaggaccacccttagccacaggacatattttcaaggcaccatttatgttcccttcattgctctgtacacggttttcgataacttagtgtggctatctgattaatgtctatctccttctggagattagaagcctgcagggaggcaaagatcccagttggttttactcagtgcattgcatgaagcctggcatatgggaagttctcaatataactgatggattaaagagaaatgtaatttggcacacttgtgaggtcggtgatctgcaagaggactacaatgatctgcccctctgtgtacacacttgctgctctcccatcaagagatgagtctgtctcgcttccccttgaacctaggctggtctcctgacttgctgtgactgcagaatgaaacagcagtgatgctggaccaggtgtgagcctagctcttcaaaggcctcacagtttctgccttgactttcttgggggagagctgccatgctataagaaggtggtttagaagggaacagaggccaccaagactcacagccagcttcaattgccaggcaagctgggtgctgacgtacttttgaccatagaatcatgagacatagatggctgctgctttaagccactaccttttgggatggtctgtggtgtagtaagagtaactgaaacgctggcttcttatcttaaaataaattctagccaggtgtggtgactcatgcctctaatctcaatgttttgggaggctaaagaaaaaggattgcttgaggtcaggagctcaagaccagcctggacaacacagcaagatcccatttctataaaaataaaatataaaaattagccaggcatggtggtgcatgcctgtagtcccagctactcagaaggctgaggtgggagaatcacttgagttcgaggccgcagtgagctatgattaccactgaactccagtctgggtgaaagaatgagatcctgtcattaaataaataaataaaataaaataaatcctaatggcactagtttttcttcacaccattatctctaagaggtgaaccttttccatgagaactagggaactgctccctttgtacctgcagtgaagcaaccctcaacccctggttatcttgggcatccgcagagggtttgggattatcatatatcattgtatgtacttgtcctttttccttgtcatttttcatatacctttgctaggtatctaattgttcagatgttctgctccattagggcagggatttatttgtctttatctccagtgattctatagcttcctggcaaacagtatatgttcaatgaaactgctgaatgaatgaatgaatcattctctgcctcattgcctccacctgataaatccactgccagctgtgccctcctcaaacatccaatcttaaaacacatttttctgctctatcaatgtgctgcctcctgttcttttataaacataatcctcaaatattctatgtctatgtaagccacatctcagcccaatgctgcctcctttgattcagtggcaacagcaatcaatggcttaggtcctataataacgctgggttttgtgtttaaatcagataacatatccagaattcagacacgtaactatgttttcagtgattgttgccttttcatcttctttccaatgctttctatttcttagaatgccaaggacatccacccctcatggcaacatctgcatgttgacatacatcagtaatggtctgtgaatcatttgaattctggtaagatgaacatttattaccatttactctgagttaggcactatgctgggcagctgacctatataacatcccctgttatatgaaaaagaaagcctaggtttaaatctcaggccaacagtttctccattcagcagcacactgcctctggaactagtgggctctagacaatgagatgaaatcaacaaagatgattcataggctttagatgctggagcttcctgagaagcagagttcttatccttccttctctttcgtaggttgaaggctgacaccgtcatagtctctctactcatctccatggccaaaatttgcttttgaaagcatttgctccaaagtataaatgactgttaacaactgcacatggcacccccctcccttgaaggcattctgaatttcaaccaaacatttaggatgcaaaaatggaacaagattagcaagatttagacttggaagcaggcaagtcagattcctcccaacagtcatgctattcaatgcagcaagcaacccagccttagtggaaagaagcttgggaaaagggaacgtgagacttctcacaatatacaggaaggacctttgcagtcaaatagcctactcacctgattttcctgggtcagtccctattaaacatgggtgtttcacttctcagctgtggatagcacactcatccctgccctggtttcagtttttaatctctttcctctcccgcagcctagtgcagaccgacagcccttttctccaaaacagcacgtcatatttaagaatgtatgtcccttgaatataataatatgatagtatatttattcttctgctcacattttgcatgaaaaacatacttaagacagttaataaaaaaacatataacatctcgttgacgacccagcagaagtagtgccatcttctttaagtctctgctctgtcaatggtcatgcatgtagaagcttctcagtgacctctcggcacaatgaactgctatattccttagcacactgtaataatatcattctgagcaccatcctgagcaccatgtaataatatcactctgagcacctatgtcatagacttgcaataattgttgacaatttgtctccttaactagactgtgaggcccttgagggcactgtgttttattcatcttttttattctgtgtagctgagagcctggtgcttattacatagccagtacattcttggaggaaatcatctcttactcaattggtgtcaggaagaaattgagagccacagactggcaggttcagggatcctttgcactactgagcagctactcagaccctgtgaactgtatgttccctacttccctcctgtcatatcatttttcttttttttttttttttagacagaatctcgctctgtcacccaggctggagtgcagtggtgtgactcagctcactgcaacctctgtctcccgggttcaagcgattctccagcctcagcctaccaggtagctggtattacaggcgtgcaccaccatgcccagctaatttttgtgtttttagtaaagacagggtttcaccatgttggccaggctggtctcgaactcctgacctcaagtgatccgcctgctcagcctcccaaagtgctgggattagaggcatgagccaccgcgcctggcacctcactaggatttaaaagaagcccagtgattccgagggctcctgtctaccaccacttctctccaccacaacatcttctcctccacactgctgactccctgggagagcaaatccaagagcgggctatgactagtcagagcatccacctcccctagatgactccaggacccaggccattgtttctcatctctatgcatagctcagccaccactgcaagctccaaactctcaggccacccatcgtcacctgggctccttctacaacctggctgtggatgctccctaacctgaccgagtctgtgtctcttcacacacacactctctgggactcacagtaggtcctcagcattgcctcctgtatccctcagctgcttagctcttagagaaaaacacacaaccctccttcccgctgtactttaatgttatgaccgtaaatctcagataggccttcaggacttcccagtgactctaccaaacttccataaaatgtttactgtcccactctcaaagatgaatctttcacaccttctctgaggctaaaactgccatcgttccccattcctgactctctcttagctgatgaccttgcttcatatttcactgaggacataaacatatcctaaagagatcactatctctctccctctgtctctacttgcctcagggctcacacactttgctctccttgtcacttcccaatgctccccttgggcactgaatcccgttgcctcttttgcctatcccatcagtgcctctctctatcccatcgttcccatcagaatataaatatcatgtcatatccccacctcccaccattgaaagctctctctatacccctccagctacaccgcatctcctagctccagtgtatagcaaaacctttcagaagagttgtctattttccctgttcccactttttttatcctttgttctttctagaaagtacacaatcaggcttttggttccatcactcctctggacctgtgagcctcacgtgccttcctcctatcactaaaaacctgcttactgccaaatctagtgttggctcccagtcctcctctaacctgacctctcagctgcatgtgacacagctgattactcctgccttcttgaaacattttcactaggcttccaggacatcacattctcctgatttttcttctccctggctactcctttgcaatcttgtttgctggctgtttctcctgtttttcctgacctgacccccagaggctctgttttttttttttttttttttagatggagcctcgctctgcacccaggctggagtgcaggcatgatctcggctcactgcaacctctgcctcccgggttcaagcgattctcctgcctcagcctcccaaatagctgggactaaaggtgcagaggctctgttcttatctctctttactctctttatcttttctcttgtcaacctctccattcttgtagctttaaagatgttgatatatcccaagtttatatctgtagcccgcctcctctctaagctccaaatctatgtaaagtgtataactccctacttgccatctctacttccatgtctaatgaatgtttctcaacacagtgatacaaaagaaaggctcatacttctcactccctgcagccccttgcagccacataactctttggttttgccagttttagtgaagtgcattactatttactcagctattcaggccctaaacctacctatttctcacacccttgtccacactcatcaactttacctgtaaaataagtgctgaatgtgatcacgtcttaccacctctacctgtctcacctgagtccaagatgtcatgacctctctcccctcgacttctaatagccttttaactagtctctgcttctgctcttgcccccaaacagccaattttccccccaacaaccagaatgatccttcaaaaatataaatgagactggccactcacctgctaaacacccttgaatgacttcccaccacaattagaataatatgcaaactttactttggcctgaaagaccccatatgactttggtgttgtctatctctccaatctcttcttgaacttgactgccccctccctgtctgtagttgagccatactggcctctgtgatcttcattgaacaggtcaggctctttcccatctctgtactcgctgctccctctgcccaggaagctcttcttcccagatcttgcaagctttgctcttcagtccagtcaggactctgctcaaatatcacctctttagacagaattttccccactacccactaaagcaggccctcattgtctttgtcactttctagcctctcatcctgttgattttttgatagtgcatgttaatcttgacattttaggatacaatcatttgcttatgtctaccctttccaaatacaaccgtctcattggcaaggacttttctgccctgttcatccaaagtgcctagaacagatggtccataaatacttgttgagcgagcacacgcatgaatacgtgtgcaaaggggctcaggtaaagagtgtaatttctataatttcaaagctgtgatgtacttccaggagcagagtaagtaataatgatgggcaggcacaatggaaggccaggtattggattaaggagggcctctctggcagccctacaggacagacatttctgcaatgatagaaatgacctatatctctgctgtctaaaacagtagtcactggccacgtgtgactatggagcacttgagatgtggtcagtgggactgaggaattgaggaactgaaagaattttatttaatttcaattaacatttaaatagctatccttggctggtggctatggtattagaacctgaagaatcccttcccatggcttgtgattgcaggataattgtgtataactcactgagttgtcgaggggactaatgaaataaaaagcttaggaaaatgtctggaacataagtggcacaaaaaaataatagttgctattattccacagagttgcaaattaaagtactttaagtatatgccatttaaattaggctgtaaagcacttgaaatggacttttattaatgttaggcataatgttttgttttttagagttggtggataatcgatgtttgggtctgtatttgagcttacaaactaaaaatagcacacaaccattttgggatctcattgaaggagatagatgtctattccaagtggatcagcttgctgatacttataatgagctaattaattttgacaacagctaatttagcatctgcaaaaattggatttgtaacattatgtgtactgtattattttcaaacagtgttatctgcaacttcccggatgattttggataagagaagtgtttgttttaatacttattattaaaataaaaaaataagtatttacttattggaaatactatgattaattatttaaggcttaaattggtttggacataaaatcatttttttttcttagtggctgaccataattccttccatactgaatccagaaaataaaattagcacagatatagaacataaacagaccattataacaaacccttatgaataacctaatgcaataataaaatcacacatttgtccagaataagcatggtacttattttcaggccaagagaatttgcattctgtagcagagtgaaaatggcattccacagtcagcctaagcacttggtggagactctgagactagagagagcagatgcatttaaattgaacacgtgcttataggcattaagaaaagttgacattcttattaaagagaccaattaatctgcatcagttggaagccactttacagtcgaaaaagtgctctaggacctaatataaatgagactggagtagaaagagaatgaaaattcacttttctacaagggagccttttctaattgccctagagctgtgctgtttgaaatgctaatccttcctcttccatcccggactgggagtctggggtaacagaagccgaggagggtgaagacccccagatgctaaagtgaggggtgttcaagacttaccaatgggcatgactaagaaaaaaggcagccagcagaggacgaagcagccgaccacgatgcccagcgttttggccgctttcttctcccgggagaacttgaggagcctcactgagaagtgcgtcttggtcttggcgctggccatcccgctgcctcctgccggggcgtttttccgatggatgcggagcgtcacttgctccgagtccgacttgtcggtcttgaggccagacttgaggccccggctctccctcttggccaccacgtagacgcggcagtacatgaccaggatgatggccagaggcaggtagaaggagcccagcgctgagaagagcacgtagcccggctcctcgttgatctggcagatggtctcgtcctcgggggccggctgcctccagccgaacaggggtccaatggatatgaccagggagagtgcccagacgcagagcagagccatgagacccctcctctgggtgacgatggttgggtagcgcagcgggtagctcacgccgatgtagcggtcgatggagatgatgcagaggcccatgatggacgcggtgcagcacagcacatccactgccgcccagatgttgcagaagaccctgccgaaggcccagtagcctaggacctcgaagatggcggagaagggcagcaccgtggaggtgagcaggaggtcggccaccgccaggttgacgatgtagtagtgcgtgactgagtgcaggtgtcggtgacaggctacggagaggatcactaggatgttacccagcaccccgaaaagaatgaggccccccaagatcaccccgagcagaatggccttggaaatgttcaccggtgccggcggttgggtgcagttggagctgtcggaagcatttcccgagagaaacaccatggtcccagccggggccgggcgaggtccggctgtccagggccacctcccgggctggcgcggaggcgggagcgcgggagccgggaatcaaaaggtctcggctggagggagccctgccaggtgggtttggctgggggtgagagcgcgcgcgcgggtgggaaacaaccctggccagccctgggaaccctcagaaggccacatgaaggggcagggcattaaagacatggccaggggcgcgcggggctgccggggaccctctccacctgccgggctggcctagcccgggacccggactccctccctacccgaagctgggtgcgaagatccaggagactccttgcaacatgcaattccagaattacgagaatctgcttttccgcgctgtcttattcgtcctggctgggggaagattcagcattctgcacatgattcggaattc

SEQ ID NO: 1425 - DNA, 53550 bp, Homo sapiens
ttggagttgaggaattatttttatttttaaaagggaaattaacgtagacaaatcgtaacatgtaccccaaatccaaatggattaaagacaaaaatgtcaataaaacatttgtggacctttccaatagaaaaaaaaaaagagcaaactctaactgcctacaacattttaaatctagaatcctatattcaatcaatatggggataaagttcttccccttggataggagaggtttcgtttggttttcttttaatttcctccaaaacaatcattggcaggaagcttctgcaggataagctccaggtgtagaaaaaaaaaaaaaaaaaaaagtttgttggagaccataggaatttcataaaaatattgaaactgaaaacacttaaaaagcattccaaatcagctttccaatctgcaacctttgttagaatgaaggcaacaagaaaatggtctgaaagtgccagggaagagaagaggaaggacacagagccctcttggtcccttcagcattttcaggagacagaatgccacagagaattttccacagagctgggcatggtggcacactcctgtaatcccaacaactcaagaggctgaggcaggaggatcgcttgaggccacaagttcaagacgagcatgagcaatgtagtatgacccaatctttacaaaaaaaaataataatcagctgggcacagtggcatgcacctgtagtcccagctactggggagcatgaggtggaaggatagattgagcccaggagttggaggctgcagtgagccactattgcaccactgcactccagtgtgggcaaaactgagacaccaaaaaaaaagaagtgttctgtggttgcagagcaagagagagaggaggcttaacagattcccaccctgaaagagaaagtaggaagcagagtacataatagcactcaatttcctttgagaaaactgccttccctccattgtgagaagtcttcacctggagggcctgcctcctcactgctgcagccaggagccaggtcttcacccacttcccagggagtcacaagagcctggctgctaggctcagcgaatggatgctctctccaagtacagcaagatcctaagcaagttaggctttagtgccgtggcagaagcaagcatgctgaacacaattccccgcatccacaatggaggctgggcattgccagcagtagcggttggaacacaggatttaggaggaggcagcagttatgaaatgctcaagataaccagtaatgagcagcacaagaccccttgcaccttcaaatataagaccagtaataacacttacaaatgtacattttaacttggatagttaaaaatactaacaagtgatttatatctgctaaatcagcaaaaaagaacaaagaggaacaaattgaaggcatatgttttaatgaacattataaccaaaaaaaattgagtccttgtgctagaaacatgtagaagaaaaattataaatttgtttcaaagaaagctttcagaatcagttttacctaaaatctatagctaagattatcactcccacataccctcacccatgatttcttcctgccaaccttctctcaatagctatatcagtatttggcttgattcatgttcaatattgacaacagcatgtctagttaaatactgctcgcagctggccatgggacatattatgaatacctttgcttcccagatacatttataattgtttagtttttcatttgcttacttctctgggccataattcaaccccaaattatttgccatttgtccagatctctccacatcctgatggatcaggttgtctacaaatgtcatcttgttcaaaggcctctgctccattctaacctggcaggagtagaggggtgccatgcagaaggggagcagagaatgccaggaaggcaggagaacaggggcctctgggctgaaccagcccaaaggctcctgtgcagcttcccagtgagaaaaggtgagactgtcagcaaagagaaagtgaactttgcccagctctctatgaccacatgctgccacacacactgaggattgagaacagatccaagggcaaccgcagacgcctaaagctaaagaaggtggtctaaggttgtataaaaaaatccagatgcacttttttttttttttttttttgtagacaggatctcactgttgcccaggcagtggcacaatctaggctcactgcaacctctgcctcctgggttcacacaattctcctgcctcagcctccctaatagctgggattacaggtgcctgccaccacactgggctaatttttgtattttttggtaaagacggggtttcacgatatcggccaggctggtctcaaactcctagcctctactgatccacccgcctcggcctctcaaagtgctgggattataggcgtaagccaccttgcccagcctccagacgcattttctatacaactctgcacgggcaattttggcctcagagtcctccagcaggtggcagactccagcacaggaacaaaatctgtctaccccagaaatctcttccaagttgacacagccttcataagcaagagccataactgtgatgaatgcctgttgtcattttaagcactgcaagttattccacatgaatactgaactgtggtccaagcatacaggggaatgcatccccctttcaatcacacgacatccaacacatgccataggtgggtaatgtcaagcaatattcaccccccgcccctgaatccttcacttggtcaggagacaccctgtatctactgcaaagacttctgttttctcctcggttctgtattttcccaaattcctaccctggtacgtactatttttttctaattacaaaataatcattaacttttaaaaagccatgtacaactagttgacataataaaaatccacctaactcatcttttagtaactatggctatgttgtaacaattttattttgatttttaaaaaaggaatctcttgatttaatcagggctttggggtcatagggggattagtcactgtcacagtcataataatgcatttattcagggaaaactttaattttctttgtcttctccaaaaacagctgctggaacacctcaaattaagggatgttcatctaaaacacctttactgaaacttgattccttgggccagaggaaggtctttactgtagttgatagtactagtgggaaaaaataacagaattaatgacagtacatacataacagaagattttcatgcccacttttaaaatgtagcagatctgtatatattaacaaggcaagatctccaagttacaactttttaagacaaacctttaagataaaagacaatgttagtatggatcccgttttatttaaaagaaaaaagacagaaacataaaaatctggaaagacataccatacatggttttttttgttggtggtggtttttgtttgtttgtttgttttgttttgagacagggtctcactctgtcacccagactggagtgcaatggcacaatctcagctcactgcaacctccgcctcccaggctcaagcgattctcctgcctcagcctcctgattagctgtgcaccaccacgcctggctaatttttgtatttttagtagagacggggtttcaccatgttggccaggctggtcttgaactcctgacctcaaatgatccacctgcctcagcctcctgaactgcttggattacaggcatgagccactgcaggcgtggatcacctgaggtcaggagttcaagaccagcctggccaacatggtgaaacccggtctctactaaaaatgcaaaaattagcctggcatggtggtgcaggcctgtgatgacagctacttgggaggctgaggcaggagaatcgctggaatctgggaggcggaggctgaggctgcagtgagctgagatcaggccactgcactccagcctgggtgacagagcaagactccatctcaaaaaaaaaaaaaagtgtgccctcaaaagtgcaagaaacagcccagcatggtggctcatgcctgtaatcccaggactttgagaggccgaggcaggcagatcacctgaggtcaggagttcaacaacagcctggccaacacggtgaaacccaatctctactaaaaatacaaaaattagccgggtgctgtggctcacgcctgtaatctcagcactttgggaggccaaggcgggtggatcacctgaggtcgggagttcgagaccagcctgaccaacatggagaaaccccaactctactaaaaatacagaaaccacgcacgagaccatttcattgttgggtgctgggcactagctgaagctagacaagaaggctagaaaaatagcaccaaatagatacttagaggagacagctgtggaatgctggaaaaatcaaatcaaatgacactgcacaaagacagcacagacagtaggaaagtgtaaaagcccattcccaagggttttaagcccaaacctatcttcccaaagccttttcttaccaagtagaccttctcatgtactgtttccaggcatcactgccagactccctgccaccaccagtgtgcttttctcctcctagagaaataaaaaataatatcatatcttctgagcagtttccatgtgggctcatagttggtatcaatgaaaagaagataccaaaaggacaccagaacaacctgattatttactttacatttagcccacaatatctcccctgcaaacaaatcaaagacagagaccaagagaccaaaacaaacagaaaaaaggaattaagagggaaaataaaatataaggaattaagaagaaatggaaacagaaagaaacggtaaaaaaaaaaaaaaatcccattagctgggcgtggtggtgcatgcctgtaaccccaccgtgcccagcccacacatgttattcatagtttttcttttgagcagggcacaagaatatgggagctgtaactgtcttctttatctctctcaataacttgtattaaattatcagggaaaacacaaatattcccatttgatagaaatacattaagaaaatataacaattttgaaataaaagcttctctattaactactcacctggtctttctcatgagagggaaagaatctccattaaatgggttccagaaaaatcacagctgaatgtttgcccttctagctctcaaatgcacaagcaaagtaaaaagagacataactgacttcaaagaatgggaagccagcaaaaagcctgcacacatttgaaataaaacaaaccacagctaacagcgcctctgaaactcctggcaggaacagagtcgcagaggctctaaggaaccaaggctgagcacctgcctgaggttccggagctagtgacagcagtaaatgggactgggatggtgtctcttggttcctcacccagtgctcattctacaagataacacctcatgggtcttccccaacaaactcttttattgcacttgaataaaagctatttctacccaaggtgggcagggagggagtagggagagagcgaataaaagcagaagaaacaagtcctagtcaaaatctcccaagagactccctatccagctacgcacatgctgggggaatgaactaatccactttcaaggaccatgctcactattctgagagctggtaccccactgccctccgcttgctagccaggcctgcagggccctccctgcctctgttttctactgcttcttcagtatgcaagggtactgggtgcatccaagaagaaaatgaaaagaacagcttcttctactttctcctactagttgactcccatgtgtcctgctcctggacagaaacctctatcataatagagggtcaatacataatgtctaaagctttcaaggagacagcagtgaaagcacactagttagaaaaactgacatcaattcaaaggtaaatttgcttttttcttttagtaaaaagaatctcggccaggtacagtggctcacacctgtattcccagcactttgggaggccgaggcaggtggatcacaaggtcaggagttcaagaccagcctggccaacatggtgaaaccccatctctactaaaaaaatacaaaaattagccaggcatggtggcgtgcacctgtaatcccagctactcacgaggttgaggcgggagaattgcttgaactggggaggtggatgttgcagcgagccaatattgcaccactgcactccagcataggcaacagagcaagattccgtctcaaaaaaaaaaaaagaatctcaatgtagcctctgggaaaggaggaggagaagaaaagtatgagcaaaactactttttccattataagacttttttaaaacttttatttatttagagacagggtcacactcactctgtcacccaggctgaagtgcagtggtgggatcatggcttactacagcctcaaactcttggcttaagcgagccttgcacctcagactcacgagtagctgggaatacaagtgtgtgacaccacaactggctagttttttttaatttttgtagagacagggtcctaccatgttgcccaggttcatctcaaactcctgggcttaagcaattacaggcatgagccaccatgcccagcccaaaactttttttttttttttgcgggggaagacagggtctcactctgtccccagacttgagtgcactggcacaatcttggctcactgcaacctctgcctcccagactcaagagatcctcccacctcagcctcccaagtagctgggactacaggcacacaccatcatgcctagctaatttttgtaatttttgtagagatgagtttttgccatgttgcccaggctggtcttgaactcctgagctcaagcgatcggcccacctctgcctcccaaagtgccaggatttcaggtgtaagctactgtgcctgggcaccaaaactttaaaaattaattataaaagcttaaatgaagaatagtcaattgactgggtgcagtggctcatgcctgtaatcccaacactctgggaagccaaggcaggtggatggcttgagcccaggaatttaagaccagcctgggcaacatagtgagggcctgtttctaaaaaaaaaaaaaaaaaaaaaaaaaatttaattagctggtgtggaggcacatgcctgtaatctcagctattcatgaggctgaggcgagaggaatgcttgagcctgggaggtggtggctgcagtgagctgtgatcgcgccactgcactccagcctgggcaacatagcaagcccccagctcaaaaaaaaaaaaaaaaaaaaaaaaaaaggaatagtcaatcagagagagcaggcatgggttggaaacagggattaaattagtacaaaaggagaagatagacactcatgcattcaggcaactgcacagtggagtgcaggggcaaggggtgaactgaaaacagcaaagtccgtgcatcaaatagtaattgtagtatctgctctaaaaatgtaaaagaatgctactaatgatataaacttttacaagtattaatgcatgtttgttttgcttctatatttaaaaaaaacaagcaatctgttttattttactttggatcatttttaataaataatacttaatatacaatggttagggagagtttttaaggaaaaactactaccaagtttcagcattaataatgtatggcttattaagaggaaacaggagcagggcccagtgaaaagaaacaactttgtattccatctagtgaaaaagagtatgtttaacatttatatgcctactttgcaaataaaaaccagaatatttcatataaaattttctggctttgaagcagggattcttaatcttttttgggtctggaaacttctccccagaaaacaaatgccaccatttcaggggttcacacatttcaagttaagggcctctgctctaacctgatgctgcctctgaggagatgacgcaggactctatgcgataactttgaatacagaatgtaagctttttcagatatgttagatcacataaggttatttcagaatataaggagtgtttcagtctcttggtcagccttttctaaaagctactactggtttttctttgctgcccaacatggaaaaggagaaatgattctctacgtaccaaaggcacctccaatctcagccccacttgttggaatgttgacatttacaatgccacagtctgatcctttaggtctgtgtaaaaagggaggcatggtgagagcaatgaacaggaaattaaaaacaaacaaaaataaataaaaaatctaaaccaaagctcaaaggctttcaatactgaaaaactgattttagactacagcagtttttttaagtccactcaccacataaatcagacttatataaattttcaaaatagacaaagttgtacccaagccagcgaaagattctgcccagatctttggtaaagatgctacttgaaagtccctgttttacttcattattccatgcaaagacctcttcttcattctaaaaggagagacattggaagctgtaagatgttatagtgttcaagtcaaagttcactgacattaaactcatttcctgaagtgtaccagtataatttcagtgtacaaaaggaaaccaaagagtcaagtttactcactctgtttctcttataattcagatcattgataataagtaaaaaattttgggatttttcccctaattatcagaaacaaatattaacacattcttcctttcattcaagctactacatataatagctaatatctattgagctcttacgtgtgtaacacaccaatctaagcacttaacatgcatttagttatttaatcctcatcctataacacaggtttcctactacctcccaatttacagattgggcaactgaggcctacagagactaatttgctcaagagctcacacagcctcataatgtacacaaacacattacaaaacacaaaattatattctctagtccccatacgtgaaacaatgataggcaatttaaagcaagaaataaagaagcaatgatgtaattgcaacaagatgcaattctcactattattttactgttaataatggtacattcaaatattgattcaatctctgcagtctcaaaattaatcctaaatatttactggcgaggctagggcccgtctcaagctagggaatgagatcttctaatttatccacctgtgtgggttttttgggttttatttatttgtttgttttagagacaggatctcttcccacctcagcctcccgagtagctaggactataggtacatacaacacctggctaattttttaatttttttgtacagacaaggtctcactgtgttggtcaggctggtcttgagcacctggcctcaagtgatcctcccaaagcactgagattacaagcatgagccattgtgcccagcttcttcacctattaaaacctttacagtttgagatcaagatatgagatcagggaaaacaaaacaaaactccgcagcctgtcctctgctggagtttataactataggtcttttttttttttgagatggagtctcactctgttgcccaggctggagtgcaatggtgcgatctcggctcactgcaacctcagcctcctgggttcaagtgattctcctgcctcagcctctcaggtagctggtattacagattacaggcgcccaacaccacgcctggctaatttttttgttttttagtagagacggggtttcaccatgttggccaggctggtctcgaactcctgacctcaggtgatctgcctgcctcaccctcccaaagtgctgggattacaggtgtgagccaccgtgcctggccaactataggtctttgtattacccccacatgttctcattttgtctgctgacatgttcacagcactcaggctatcaaactatccagtaccacggttcaggagaaggtgactctatggcctacacagcccaggattaagatgacacaggaaatgaggaccacacacttcataaactccaacactggtccactacccaatctggtttccctggcagctagcttggcatgctatagagttttaaagtgtttatctcatattttatcctgaaccttcatatatctactattcagattactttctaaaaccctcttaaaggttcatccagtgaaatttaatccaccatcattttcctcttatcatttatttcaacatcaggctagcgaacagaatgcatttttaccttgaatttaaagacatagagaatcggagcaaaagtctctgtgtgtgcaatggacgcatcgtggccaagacctgtcacaattgtcggttctacataatttccagggcgatccataacctaatgcagagaaatgaaataaaaagaatgaaagcattttgttttctaggacttggggtcagaggatgcaatctttgcctacatttataaagaaaaaaattagcatcatttataggtgaattatttctccaaaataacttccaatcatgaaagaaaattctctcttcctgatattggttctaacttagttggtcagagaaaaatggaaataaggagtcaggcagggatagagagccatgccatgtgacacaaccaagttatgttgaacaaacactgctgcaagcggttattttcactcagcctgtagtgcaatggcttgatctcagctcactgcaacctccgtctcccgggttcaagccatcctcccacctcagcctcccaagtaactgggactacaggcatgcaccaccatgcccagctaaattttttttgtatttttagtagagaccaggtttcaccattttggccaggctggtcttgaacttctgacctcaagtgatccacctgcctcagcctcccagagtgctgggattacaggtgtgagtcaacatgcccggccacaaacaaatctttatatgtggggggttttttgtttttgattttttttttttattatttggttttttgtttttgatttggtcttgctttgttgtccaagctgcagtgcagtgacatcatcatgactcattgcagcctcgaacttgtgggctcaagcaatcctcccacctcagcctcccaagtagctagcactacatgtgcatgccaccatactcagctaatttttttttgagacagggtctcactatgttgtccaggtgggtcttgaattcctggcctcaagcaatcctcccaccacagcctcccaaagtgctgagattgcaggtgtgagccactgcacctggcaatatgtgttaatttcttttttaatgcttatgatatgtatttttttattccttgccttaactgactttttaaaataaccaataaatagattataattgctctgaatacaaagtctcctactgtacttgaaaaggaattttcctttccatacaaatattaaggacccaattcaaaagcaaccatgactccgtttcttctatgtccttccagaaatgtcccatgcattttctgctgtctttttttaaaatatggaatactttttaaaatacggatatgaatttgcatatcatcattgtgcataagccatgctaatcttctctgtatctttccaattttagtatatgtgctgccaaagcaagcattgttgtcattctttaaaacgtgtatttctggctgggcacggtggctcacgcctgtaatcccagcactttgggaggccaaggacagtggatcacgaagtcagaagttccagaccagcctggccaacatggtgaaaccccttctctactaaaaatacaaaaattagctgggcatggtaatgggtgcctgtaatcccagctactcgggaggctgagacaggagaatcgcttgaacctgggaggcgaggttgcagtgagctgagatcacgccactgcactccagcctgggcaacagagcaagacgcaggagcctgaggtgggaggattgctttagtccaggaggaagagggtgcagtgagctgagatcgtgcaccactgcactccagcctaggtggcagagcaagaccctgtcacaaaaacaaacagagccaagtgtggtggttcatgcctgtaatcccaacaccttaggaggccagggtgggtggatcacttgaggccaggagttagagaccagcctggctaacatgggaaaccccatctctaccaaaaaatataaaaattagctgggtgtggtgacatgcacctgtaatcccagctactcgggaggctgaagcaggagaatcacttgaacctgggaggcggaggttgccgtgagccaagattgcgccactgcactccatcctgggcacagagtaagactctgtctcaaaaacagacaaacaaacaaaaacatgtgtttccttgttttataataatatatataaataaagacaggagaagaaggatgtcaaatggggtggcttttccaatatgcccagagccctgcttgtgtctcagggaaaagaaggttaaaaagctgtcacaattgatctcagagcatcccttaccttgcccccatagaccactgtgccaccttctttctttgcttcttccactgctccaagaaacatgctcactgcctgcttggtgtggagtggcccatagagaacattagctggagagagaaaaggaaggctggctcatcattttgccctttatggcatcgttttattattagaacagctttctcaatgaacagaccaatcccttcctatatgctctcaattgagaacataagtcagcatcctttttccataaagaaccagatggtaaatattttatgctttggaggacatacgtgatctccatcccaatactcaactccgtaattgtagtgcaaaagcagccataaatgacatgcaaatgagtgggtatgtgccgagaaacttttttttacagaaacaggcagagccaagtctgtttgccaatctctagtttaaaggaatggctatcaattactcaaagcactgcactcaaaatatagggtcagtttactcattacagtgtgaccattctctaaggaaacatcacagtctcagtagttggtgtataattcaagggggaagagaatgatgctgtcctatgttacggctgctggggactagagcactgacagtgacccagcaacaaagaagaaggaagatgtaggtaggcctctatgaggaggaggcatgttagcagagccatccccactctgggtgaagaatgtttccagcagacagcacagtaggatagagcctggcatgcctggaacactgaaaggatgttggagaaggtggagctctgggagcaagagggaaaatagacacagaaaggctggtgagaaggcaagcggggcaggaggcagagagcagaccaggaaggatcgggagcctgcaaaaaagaagaaatcaagaggactctcggttttaatctaaaagcaggcctggcgcaatggctcacacctgtaatcttagcactttgggaggcccaggcaggcagactgcttgaggtcaggtgttcgagaccagcctggccaacgtggcaaaaccctgtctctactaaaaatatgaaaatcagtcaagcgtggtggaatgcacctgtaatcccagctattcgagaggctgaggcaggagaactgcttgaacccaggaggcggaggctgcagtgagctgagatcaagccactgcactccagcctgagcaacagagtgaaactgtgtctcaaaaaaaaaaaaaaaaaaaaagaaaggaaaaaaaatctaaaagcaatgagaagttactgaggggtattttaagcaggagagtgaattatctgattgcattttaaaaatcattctgtagcaatggatgcagaaaggtcagttaggggattcttgcagccttgcacaagagggatggtgtcggcttggacaagggtaatagtaatgagagagaagcacactaaatctcattccatctaaacaacctctcccagtctcacccactagcacacatcaagcagccagggtcgaaacctaggagcagacacgatacaccaaagcctaataacctgcttcatgtgccttcacgcctctcaggaaagggaaagaaactccaaaactcagatcagaaacacttgttaacaacagctctcaaaaagggatcgctttgaaagcagaaggagatactcacggtcccatgggttcccaactcggatctgtgcataggcctttttaagtctgtttacaacctcatcatggatgctttcatgtataaactaaacgaaaaaagatattcaagggcatagtatgataaatgcacacatttttaaacaatgaataatttccttgatagttactgaaatactgtaatctctaaaaatataagaaaatcaaagcatgtttatttttttaattatataatttatcattttaatattaactatatgaagtcaaaattttccttttaggtagataatagaataaaatcataagccatgtctttttttttttttttttttttgagacagagtctcactctgtcacccaggctggagtgcagtggcatgatctcagctcactgcaacctccacttcccgggttcaagcgattcttatacctcagcctcccgagcagctggaattacaggcacccaccaccacacctggctaattttttgtatttttagtagagacaggcttttgccatgttgcctaggctggtcttgaactcctgacctcaggtgatccacccacctcagtctcccaaagtgctgggattacaggtgtgagccaccacacccggtccataagccacatcttcatcaagtttccaaggatgtatttgtctaagcttcacaaatacattaaagaaggcctcaagtacatgtgtcccatactgtaaccctaagtcccagtgaacacagagcatagtcataactgacctctgctgggtaactacaaacacttaaccccaggccacacaggtctccagaggaggccttaattaggtgaggacaacccttgcattctctgggtagttgtcaggtccatgctatgctccaagtggcagagctgaacttgccaaaccatctatgctctgggttagtctccacatgtgatgaatgaattgacattatgagaactagtcatgaagcagtccatagtaatggaatttttaaaaatattactgctaactctaaggaaatctatttggacaatgactaatattacctattaatatttaaaactaatataaaagacgtctatgaatatttgctccaaaacacatgaaaaaaataaaaattggctgaatagagaaatatttggcttttatgtcatttcatattttaccatgtaatgaagggtataatcatttggagtgcatggttttttcttagctttaacgtaatctttaacgcaatttaatgtttatggtgaacaaatttaataaactttaaagttacaaatgtagtatcagattatttgagaatgtcagctgtgtaaaaataaagatttattttcatttatgcaaaacacctgaaaaaacaaatatgaaaagtgtgagaggccgggtgcggtggctcacacctgtaatttcagcactttgggaggccaaggcaggcagatcacctgaggtcaggagtttgagaccagcctggccaacatggcaaaatcccatctctaataaaaatacaaaaattagccaggcacggtgatgggtgcctgtagtgccagctactcaggaggctgaggtgggagaatcacttgaacctggaggtggaggttacggtgagctgagatcacaccattgcactccagcctggccaacagagagagactccatctcaaaaaaaaaaaagaaagaaagaaaaaagaaaagtgtaaggtaaagataattttcatatatcttttagcttattctaattaatttagattatgtcagtcttataaagaatttgttcacactcaatatgaatgagagcaaaaacccaaagccaattccttaataattcaactgaaggcttttttcattacaaaaggaaaactcaacaataataaaaaaggctcaagtccaacagagcttaaaaataattttttttaaatggcaaatgcagccaaattttgtacctaactaaaacttcctcagggctgggcatgatggcttccacctgtaatcccagcactttgcaaggccgaggtaggtggatcagctgaggtcaggagttcaagaccagcctggccaacatggtgaaatgtcatctctactaaaaatacaaaaattagccaggcagggtggcacgtgcctgtagtcccagctactcaggagggtgaggcaggagaatcgcttgaatccaggaggtggaggttgcagtgagcaagatcgcgccactacactccaacctgggcaacagagcgagactccaactcaaaaaaaaaaaaaaaaaaaaaaaaacacaaaaacaaaacaaaaaaaacttgctcagttatagtatagtcttttagtaccataaagtcatgaaaatcaaagttgtaacacatactaaactcaagaccagctcaatctaagtgtagagattcaacttcccaaatcccatattgaagctaaaccacatctccttatatacacttaatattaatctgtcctctcgatatatatatgtatgcaggctatatatgtatatagagaggtcacacatatacatagccatttgcttttcaatgaatcatgtcatttcaagtcaaatctaattctagacttgaggctaaaaataaaagtgtttattgattgattggttgagacagggtcttgccctgtcgcccaggctagagtacagtggtgcaatcatggctcattgcagcctcattgagccctttcctgggctcaatcaatcctcctgcctcagcctcccaagtagctgggactacaagcatgagccatcatgccttgctaattttttttaactttttataaagacagggaatcactttgttgcccaggctggtctcgaactactgggctcaaggaatactcctgcctcagcctcccaaagtgttagaattctatgcttgagccaccatgcccagtctaaaatgtttaaaatgttttactacttaaaatgtttttataaaagtgcaagactctatttttagctatagtttaataattctttttatttttatcttgttttgttctctaaatgacactggacttcgtccatattgttctaggagtaggactgaatatcagtctcatctcctagtccaactccagtcaattggtagtggaacccctattatcttggggtgggaaaaaggcaaagtccctgaatgattaacaacatctgccatgagcacagaaagagaactggaccacatatttgccagccacatctagagagcatgttgttctagcagtattgctgacacctctctaacagcagaactcattaaaaagtagtgttttaagagcaagacaatcgggcctatgcagatatactcaccagtcgcctcgcagtggtacacctctggccagctgttcccacagcagcgaagagagctgatggaacaactaagctgaggtctgcatcttcaaaggcttaggaaagcacaaacacttccatcagcgaaccaaaacaggtagacaaggtatttgttagctggtataaaacaatgttgttttttgtttttggttttggttttttttttttttttttgagacagagttttgttcttgtcacccaggatggagtgcaatggcacgatctcggctcactgcaacctttgcctcccgggttcaagagattctgcctcagcctcccgagcagttgggattacaagcatgtgccaccacgcttggctaatttttgtctttttagtagcaatggggtgtcaccatgttggtcaggccactttcaaactcctgacctcaagtgatgcacccaccttggcctcccaaagtgctgggattacaggcgtgagccactgtgcccggcaaacgtttttataaagtgcagtaaaagaacatcaaaactattgttgtaaagtaaccatatgcacgttacgaagacatatatagacgagggggaaaggcacactcttcttccaaggaagattatgagctctatgatctttacccagatatacaagggtaaattgaggctctcactcctctggcctcttcatcttttatttctcggggggttttttgtttgttctttttttctgagacggagtctcactctgtcacccaggctggagtgtagtggcactacagccttgacctcctgggctcaagcaatcctcccacctcagcctcccagtggggactgttgtagggattaaatgaaataatgcatataaaacagctgaacacagtacccggcagacactagtgctcactaaatgcgaactatattttttactgaagtctctctttaaaagtccatccagaggccaggcgtgatggctcatgcctgtaatcccagcactttgggaggccaaggcaggcggatcacctgaagtcaggagttcaagaccagcctgccaacatggtgaaaccccatctgtactaaaaatacaaaaagtagctgggcatggtggcatgcgcctgtaattccagctactcgggaggctgaggcaggagaacagcttgaacctgggaggtggaggttgcagtgagctgagatcgcaccactgcactccagcctgggtgacagagtaagactcccgtctcaaaaaaaaaagttcatccagaacaaacacttcaccatatacttcttatatcttacacatacttcttatgtgtgtcaactacaaatatctaagcatttttgtgacaaactcaaacagttaaaaaagagcataagtaatctctaagcctataggtaagtgatttttttaatgccttaaggacatgttccttcccaatataaaaacactcaatattccactaaagacaaaataatgtttttgaaatctaaagaaatgatcaagtcacataagagttacttaagttattctagagaaatgtggccagttttcagcaaacagaagaagaaaaaacaagaaataatgccatactacaatggcaatggaagtctcattcacaggttctagatcatcccaggtaacatgttctaaacatgaatacctttccttcctagttacctctgccttcaaaacaagcttgtgtcctgtctcccaagtaaaattcctaaacacaggaactaggtctcaggcatatgcaacatggacgaaatgagatcccaaacaagttccatatattcaggatggcgactgtggaaactgaacagaaaacaaacaaaaacaaagaggcagccttaccaataatggcattgtttcctccaagttccaacagacttctcccttaaaagaaaaaaattatatataaaaattaatgcctacttccatatttactgcacactgctacacagcctaatcccaattattaaattatatagcctgtccaattattttttatatagcctatcccaatcatatagcctatcctgattacaccctatcccaattatttttcaacttattttctaatttataaagtagcattactattgtatcaatatcaaatgtcctgattttagtaactactgtggttatacaagaaaatgtccacattcttaggaaacacaccaaaatatttagtaataaaggggacacatctttgacttactccaaacagttcaacaataatatgcacccacagagtgtgtgtgtgtgtgtgtgtgtgtgtgtgtacgtgtgcgtgcacgcgcgcacagatgttgctggagagagagaaaatgagaaatcaaatggggcaaaatgtaagcaattagtgactctgattaaagggtttacaggaattccttatgttggtcatataattttggtttgaaattaacaggaaagtctacagccaaaccaaaccaccctgagcgtgcccagtcttatctgacattactcaagaaaaataaagtaaaatgggatagccactgtagaaaacagtatggcaattgccccaaaaaattaaataacagagcctgggcaacatggcaagaccctgtctctacaaaaattaaaacaaactagctgggcatgatagtgtctgcctgtggtcccagctactcgtgaagcccaggaatttgagacaacagtgagccatgatcacaccactgcactccagcctggccaacagaatgagactgtctcaagtaagtaaataaataaataagagaattaccacatgaccgagcaattccacttctgagtatataaccaaacatagtaaggcagggactctatagatatttgtacaccaatattcatagtagcataattcacaatagccaaaaggtggcagcaacccaaatgtgcatcatctgatgaattagtaaatgtggtataacaatacagtgaaatatcatgcagcctttttttatttttattaattttttttttttttgagacagggtctgactctgttgcccaggctggggtgtactagcatgatcatggcttactgcagcctcaacctcctgggctcaagcaattcccccatctcagcctcccaagtagctgggacaacaggcatgcaccaccatgcccagctcatttttgtacttttttttttttggcaaagacagggtcttggcatgttgcccaggccggtctcggactcctgagctcaagagatcctcccgccttggcctcccaaagtgctaggattacaggcatgagccaccacacctggcttattatagagccttaaaaagaaaatcctactacatgctacacgatagttgtacgttgggccgggcgtggtggctcatgcctgtaatcccagcactttaggaggccgaggtgggcagatcaaaaggtcaagagatcaagaccatcctggccaacatggtgaaaccctgtctctactaaaaacacaaaaattagctgggcgtggtggcggatgcctgtaatcccagctactcaggaggctgaggcaggagaattgcttgaacccaagaggcagaggttacagtgaactgagattgcaccactgcactccagtctggcaacagagcgagactccatggttgtaccttgtagacattatgttaagtgaaataaggtagtcactaaaggacaaatacttataaccccactcaaatgaaagtagtccaaatcaatgaaacagaaagaagtagaagggtggctaccaaggctgggtgtagtgggaaggagggattagtgtttatagggtatggagtttcagttttacaagacgaaaaagttctaaagataggctgtatgatcatgtgaatgtacttgacactactcaactgtgtaccatcttaaccatttttaagtaaattttatgttgtgtggactttcccccacaattaaaaagaaagaaagaaacctatggcccataaggccaccacaaaaatctctacttacaatttgatagtgtcttccaatctttcctctgtgcatttatatctagttgagattatattatttcattttactttattttctgatgtcttacacctttcccctaagttattaaaagtcaagaaaagaaaaaccactccatagcattccatcatgatgacataccaaattttatttagctgtttctccagtgttgaatatatttgttgattatttacttaggttaggactcttgacagacattgccaacctatattctagaaaagttatatagcaggccatgaatgccattcttttttttcagtcagagtcttgctctgttgcccaggctggagtgcagtggcgtgatctcggctcactgcaaatctccgcctcctgggttcaagtgattctcctgtctcagcttcccaagtagctgggactacaggcatgcaccatcacgcccagctcttttttgtatttttagtagagacggggttttgccatattggccaggctggtcttgaactcctgacctcgggtgatccgcccgcctcagcctcccaaagtgctgggattacaggcttgagccatcgcaaccggcccaccatttttttttctttctttcttttttcaagagtcacccaggctggaatatagtggtgctatcatagctcactgcagcctcaatttctgggttcaagccaacctccatcctcagcctcccaagtagctcatacaacaagcacgtgtcacaacacctggcttgttttgttttgttttaagagacaggttttcacaatgttgcccaggctctggtctcattcctagcttccagcgatccacccaccttgacctcccaaagtcctgggattacagatatgagccactacacctggcctataaatgccattcttaccttactcctcccagcataaagatctgagagatgtgtttgcctcaattttagacatatgtttatttatttttgagacagagtctcactctgttgccaggctggaatgcagcagtgcaatctcagctcactgcaacctctgcctctgggttcaagcaattctcttgcctcagcctcccaagtagctgggcatgccgccacacctagctaatttttttgtattttagtagggatgggagtttcaccatgtagcccaggctggtcttgaactcttgagctcaggcaattcacccacctcagcctcccaaagtgctaggattacagacgtgagccactgtgcccagccttagacatacatttattactgatcttttgatcatcgatttccttaagtgcactttaaaatcagcttccatgtgaataacttttattcatttgtgatatcaggagcatatgtgacaacagcagagtatcttctcatttccattgctctgaaacaggtaagcatcaagtgaatattaattatgaagacatggctgttactaccaaaagccaccaaatgctacaccaactctagtctctgctgcaatcattgaattaatgacagcttgctggctatagcatagcgctatgctaggtgttaagaagagaaggaaggaaacggaagcttttacgcctgacattagcttctcctgcctggctgcaagtgatgtttggcagaagaggagggatctatactttctacatccttccagttctctatcaggcgctctctgactatactcctaaccaccaactcctccaagaaaagcacctataattaagacaggcagatacattttaaaaattataattctactactactactattactacttagccaagaacaacaaactaccgccttgagtaaggaaaaggggagaaaggtgagaagatgaaatctgctcgtgggactaatgatgttgagaatcttttcatgtgctaatcggccatttaagatgtctattctaggcctggtgcggtggcttatgcctgtaatcccagcacttcgggaggccaaggcgggcggatcacaaggtctggagtttgagaccagcctggccaagatggtgaaaccctgtctctactaaaaatacaaaaattagtcggacatggtggcgcatgcctgtaatcccagctacttgggaggctgaggcagaagaatcacttgaacctgggaggcagaggttgcagtgagccaggatctccccactgcactccagcctgggcaacagagcgtgagattccatctcaaaaaaaaaaaaaaaaaaaaaaaaaaaagacggctattcaaatccaatgcccatttttaattgggttgtcttttatattcttacattttaagagttctttatatattctacatacaagttccttatcaaatgacttacaaacattttctgccattcggtaggttgttcttttcactttttcctgatgtcctttgaagcacaaaatgctttaattttgataaaaactaatttgtcttttaattgttgttgcttgtgctttagttgtcatttctaagaaaccatcgcctaatccaaggtcatgaaaacttattcctatgttttcttctaagagttttataggtctttgatacatttggagtttgtctttgcataggagatgtagtaggggcctgacttcacactcatgtgtatagatagctacttgtgtcagtaccatttgttaaaaagaccatcctttccccattgaaatgtcttgtcacccttgacacaactgaccataaatacaagggtttatctctggacttccaattctattccattgatttttatgtctatccttatgctggtgccacatagtcttgattatcatagttttgccgtaaattttttgactgagaagtgagagtccttcaattatcttctttttcaagattgttttggccttttagggtcctttgcattgtcatgtgaattttagaattaacttgtcagttgtcacaaaacagaaaactgggatttttacaggaattgcattgaatctgtaatcatgtggaccatattgaaaccttaacaatattaaatcttccaaaaaatgaaaaggggatatctactcatttatttaggtcatctttaatttattttgatgatgatttgtagtgctccgtgcaacagacttacacttcttttgttaaatgtattcctaagtattttattctttttgacgctactacaaattgaattgttttctggatttcatttttggattgttcattgttaatgcatagaaatataattgatttttgtatctcaatcttgagtcctgcaaccttgctgacctttttcattagctgttttttaataaattcctttttaaaagcaatgcctacatagttaaacagttgacagattagtcaaatgttatcttatgctggggttaaagtctaaaattcatcctgacagccaaaaattgatagccaatattatcctcaaaaaccttggaaatcatccataaagcacagtacagtatacaaagctatgtctatacaacccttttcaatcatgtatccaggatccatatccatgatccatatgcatatggatacatatggatccatatccatgatccatatacatgagagaagagcagatttaagccttctattccacactcactgtaagttctgtactcagtgctcctgtttaaatgatgacatttttctcaccactatactaatgagaaatgatgacatttttcttctttaatttgccaaataggactagtacaatttgataagtgtaaaaagtaaagtagagcttcctcttcaaagactttcctccccatctaattaaaaataaataataacttctcttaaaagcaaaatttattcaaagacttgtgctcctaaatatttgccctggcatgcttatactggtccaagcacacattaggtcatagcctgttcctcttccttatttaagtgtttttacctttctcagcattccacaagttactttctccttcctttgttctcctctacttttgcctcttttaaaaagttctaagttgctagccaattgggagaaatacaaaatgtgaggtcccattccagccaatggaaactggacacagcagtagggtggacgcatcaggttataaatgaccctgtctcctttgttcagtgtactgtcttggcaaaactgctggcgactgtaccctttctacaggaagtaaaaatggccttactaaataaatttatgttcaagtactatttctttacagcacccaaaaacaaacatttcaaacataaatattctatgtgattcaattatacccatttagagagaaaatgacttcctttcataacttttttttttttttagacggagtctcactctgtcacccaggctggagtgcagtgacgcgatctcggctcactgcaagctccacctcccgggttcacgccattctcctgcctcagcctccccagtagctgggattacaggcacatgccaccacgcccggctactttttgtatttttagcagagacggggtttcaccatcttgcccaggctggtcttgagctcctgacctcgtgatccacccacctcggcctcccaaagtgctgggattacaggcgtaagccactgtgcctggcttgaatttttttttttcttttttttttttttgtgacggagtctcgctctgccgcccaggctggagtgcaatggcgccatctcggctcactgcaagctccacctcccgggttcagaccattctcttgcctcagcctcccgagtagctgggactacaggagcccgccaccacgccccgctaattttttgtatttttagtagagatggggtttcaccgtgttagccaggatggtctggatctcctgaccttgtgatccacctgccttggcctcccaaagtgctgggattttcataaattttggtatttaaatttaggacttccctaatattctactgctaataactgtacccttttcttttacttagacattcaaataaacatgaccactgcctccatggaaaaggttgaggggaaaacaaaaactcaacttttagatttcacctccatatttgagagaattaaaatcctcattagaaagccaacacttaccaaacctctcctgcaccatcaggcccacctgttttcccacctgagtgctcccagtgaaggacagcaggttcactcgttcatctttggccattgctgtgctgcaagggaacagacacggtcggccacccaagcagagaaacccagcaattacaacatctaatggtacccagcactgaagtgcccttgaaaaagcagtcccttgaagctacaagaaagtctgtcccaggggagcaagggaaggtcttcatgagaaggaaaaaagtttttcacaggtagaaccattaggcagaagaggctaacctgctgtgagcatttgaatagaaatcacctagaggaagttgttagggaagaaagtctttcctatactgagtgagtgactggacaatatgatcttagcatttccttgctgagcattccagttttacaaacttttaactgctgtgtaattcctttaaggattaaaacttgggcaggaccagcctaggcaacacgatgaaaccccatctctataaaaaatactaaaattagccaggtgtggaggcatgcgctacttgggaggctgaggtaggaggatcacttgaaactgggaggcggaggttgcagtgagctgaggtcaagccactgcactccagcctaggtgacagagtgagaccctgtctcaaaaagataaaaataaaataaataaaaaataaaagaattcaaacttaaaagcctgtagggaaatatcctaaagcaggggtccccaagccccaggatgctgaccagtaccagtctgtggcctattaggagccaggctgcacagcaggaggtaggcagcaggcaacctggcgagcattactgcctgagtgccacctcctgtcagatcagcagcagcattagatcttcagaggagtgtgaactctattgtgagctgtgcatgcaagggatctagattgcatgctccttatgagaatctaactaatgccttatgatctgagtggaacaatttcagcctaaaaccatccccctgccgtggtccatggaaaaattgtcttccactaaaccagtcccagtccctggtgccagaaaggttggggaccgctatcctaaagtattcctcatggaagcctacttataaaggctatgctaggatttccagttgcttctaaggaatgcaaatcagacactactgatttgaacctctttcttcctaattcagtgctacaaagggtccagtgtgaaccaagcagggcagccacagcatcagtctaacgtagggctggacggcttggctcaattgcctaggtcagtcttccaaggttcaactcagcaagcatgagcactaatactcaaagtggctgctgcttaacatgctcctgtatatactaccataattatctgagctattgcaaggccagcacaaggactaaatacctagaatgcaagaatacagtcaaaggccaactcatgttttaaatgacacttagataatatttcactctgcattatacatgtgggagttgtatttctaaaattttctcattaatatgaaaaacagagtaatgaaaaacagagtaacttattgctcctttttgagattgcccagtaagtacaatagtatttaaaagtgttggaaggcaaggaaactaacactttagccacaccagtatgggttgtaagacttgactcctgaaaaactcacctaatcaaagtctaagctggtaagaacctcagctttcatcccagttcagcacaagtatagtccatgtcatcttaatatcatgccaagtaaaagcagcaagacacaaaaggccacatgttatatgattacatttatacaaaatgtctcaaataggcaaatccatagagacagaaaattctttagtggctgtcagggcatgagggcagggggaatgggaagagactgccagtgggtatgggattaatttcttggctgatcaaaatgttctggaataagatagtggtgatagatatacaatactctgaatattttaaaaaccactatattgtacactttaaaagagagcatttcatgattttatggtacacgaattgtgaattatatggcaattaaaaaagaaaaaaacaattttactaaaaagaggctgtgttcccagggttccctttttcagtcagctgagaaactcagacaataggctaggttcttggcaggcagtgagaccccagactacaatttcatagctttctttgtaagtaaacaccttgataaaccaagtgtcaggaagtcacaggctgccccccattacagcagtttgttatttcaggatataaacaccttaacaaatagtacctctgggcaattaaaaagacaattcttattcatcctccaataggagttaggcattaataaaataagaacccaacaaagtccataataataatgatttcaaaaaccattctcaactccttagttataagtgagttcattattctagtaacgatgattctagttggtcaacctggggtccttcaacagaggatgctctcagcctagtaacctacccaatatctgctccaccacaagtcaaggaacaaattgcaccaggcagcttgttgtcctccagaaccttggctattatcctagaaaggaaaaagcaattactgaggcaataatttaaggcatttttttaaaaacaaggaataaattccaaccacttgactctccttttttcaactttctctcccatccctcaaatatactactctcttgctttttcagcccacttttcaatttctaagtcattgttcctaaatggacttctaacattaagaaccctcttataccagactctgtccttctgtcctcaaacattcagacctggatttctcctcacatattgaaaatgccgttttcaaaaaactattagcagattttttttttttttttttttttttttagccctaaaagaatcttgaggccaggtgtggtggctcatgcctgcaatcccagcactttgggaggccgaagcaggtggatcacttgaggtgaggagttcaacaccagcctggccaacatggtgaaaccccatctctactaaaaatataaaaattagccgagagtgacggtgggagcctgtaatcccacctactcaggaggctgaggcaggagaatcgcttgaacctggaagacagaggttgcagtgagctgagatcatgccactcactccagcctggaagacagggagactgtatctcaaaaaaaaaaaaaagaatcttgagaagaagaaaaaaacatagaacataaatagaagacacgaagcattgtttaggtagctcaaactgtcattgttttcaagtattttctcccaaactatgaggacacatctggttcaagacagcagactgatcactgggccttttatttatttatttattttttttttggtcttacacaaatctattaaaatgatgattaaaaaggaataagacctagaacgatgaaggaaattagaggtagtcaccaccagcaaataagagatttaaacacatctctgcaaagcagagttagagaagttgtaaagcacaaattggggaaggggaagggatccccaaaacctaaagtaaatgccacagacacaaaagaaggagctggggccaccctgcagaaccctgaaagagcttgaggctagttcccaccaaaccatgtcggtcagaaaatatcagtgccctgcaggctaaagaattgcagacaagcagagttttttctcttgttagaatgagaaatacatttaagtactacttaaatctgattttgagtcataaaaaaatggctaaaataattctggtttctctgaaaaaggattccattcattttgagtttccagaggaccaaagagcaaaggttattttcatcaatcatctcaacttactggctactttccaatttgtttaaatttcaaaaactctcaaatcccatgctcactttcatagaaaaggtatcattatcacacctaagttcccctaaaataccctttatagctgttttctttcttccttccaatccaggatccaatcaaggatcatgaactccagctctcatgtccaagaccaggtttcaggatgtacaattcttcccagggactccgggtgtctatattgtctgcacaagtagactgtactctctttaagggcaaggcttttgttttgtgcctatgggtaaaggttaacaaacccctgcccctaaggcatgagaatctaactttaagttgaactctagcactgttctccatgtcacctgataagtgtcagagtgtcatcaatgtttcttagacaacccggcttatggtaaaaatgatccctgcctggtcacttccatctgaactgagtatctatgagctattaatgggaatgccatgctttttggcctttcctgagtgcagtgacacttgtaactgcatgtccctgtggcccctgaaagctacaattgttacaagagattttggtttctgtggggcattaggctttaagccaaggtaaccccacacctctccaatggggctctcactttcttgtacctgtatgattgtgacaagaacactgattaaagaggaatacctgatgccatcctcctgacaagctatgctgctgtcctatatccttctgaatacacagaagaaccatatgtggcctggggtcatcttaggaatctgaaaatttagttgaatttacgaagacctctttgtagcactgcatcacccttagttaattccagcaaaatttagcatcattttacttatcttctattacaaaagcaaataacattttcagtgctttgaagaccatcaaccagcatataaactcttacatgaacatttcaaattcttcaaccatttaaagcaaaaaaaaaaaaaaaaaaaaagcttaaagcaaaaccagtatcaaaatgaacaatattttaaccagctacttcgtaacaattaagtcagttcactacttccacattaattattctgctgggttttgttttgttttgtttgtttgttttttaggtttatttttaggccaggggcagtggctcatgcctgtaatcctagcactttgggaggccgaggcaggcagatgacttgaggccaggaattcaagaccagcctggacaacatggtgaaaccccatgtctactaaaaatataaaaattagctagctgggcacggtggctcacacctgtaatcccagcactttgggaggctgaggcgggcagatcacgaggtcaggagatcgagaccatcctggccaacatggtgaaaccccatctctactaaaatacaaaaaattagccgggcgtggtggcgcacacctgtagtcccagccactcgggaggctgaagcaggagaatcgcttgaacccgggaggcagaggtttcagtgagccgagatcgcaccactgcactctagcctggtgacagagcaagactcagtctcaaaaaaaaaaaaaagaaaaaattagccaagcatggtggcatgcacctgtaatcccagctacttgggaggttgaggcaggacaatcgcttgaacctgggaggcagaggttggagtgagccgagattgtgccactgccctccagcctgggcgacagagcaagactctgtctttaaaaaaaaaaaaattagcccggcgtggtggcccacacctataatcccagctactcgggaggctgagacatgagaatctcttgaacccaggaagcagaaactacagtaagctgagatggccccactgcaatccagcctgggcaacaaagactgtctcaaaaaaaaaaaaaaaaaaaaaaagaaaacatattacccttgctcttttccagcccaccactttccaattcctaaaccactattctaaataatcttctaggctgggcacagtggctcatgcccatcccagcactttgggaggccaaggcaggcggatcacaaggtcaagacatcgagaccatcctggccaacatggtgaaaccccatctctactaaaaatacaaaaaattagccaggcgtggtggcacaagcctgtaatcccagttactcgggaggctgaggcaggagaatcacttgaaccagggagtcggaggttgccgtgagccaagattgcaccactgcactccagcctggcgacagagcaagactccatctcaaaaataataataatagccgggcgtggtggctcatgcctgtaatcccagcactttgggaagctgaggcaggtggatcatgaggtcaggagatcaagaccatcctggctaacacggtgaaaccccatctctactaaaaacacaaaaaattagctgggtgtggtggtgtgcacctgtactcccagctactcgggaggctgaggcaggagaatggcgtgaacccgggaggtggagcttgcagtgagccgagatcgcaccactggactccagcctgagtgacagagcaagactccatctcaaaaaataataataataataataataatattctaatatgaagaaccctcttgcccacagtctccaccccaatttctctactaataattctgaaatcagaatgcagatgcaaccaatggaacatcaaaggtacatcctaatcctacatgggaaggcaccctaactctatacatcctccaaattccagaatgacaaatcagtcacattgcttttatgacttaaccagagctgccaaattctcaaatataagtaaagcattaataattttttaaccaaaagatgcgatacattttagtgttagatgaatcagcagattagtgtaataatcagttttgttaacactctattaagcaaaagcaacaaaagtattagctagatagaaatctattctcaaaaccactaacttgttgaatagtgagaaaatatagatcctaaattgcaaaattttcctttccactgaagatgcttttattttccaagtgacaaaataatgtctgcaagagttcaatcaatatgtcaatatctggcatgtttccaaagagttaaattaaatgacatggcactgaaagcactctgtatataaaaataatattacaagcaaaggagaaagaggttatccaaattccatgctatgtgactctgacatcagattaaaaagtcagggcctatcaataaccctttcaatattattccatacccaggaaaaagaaagccacatgtacttactttgtgacagccacactaatgagggaagtggttggagctcctttccttaagaaggttaaaacaaaaaaagaaaaagaaaaacttatttgacggaaaccataaataccttttattatcaaacagaagcaaaagtgtgagaaaaagctctgtccaattagacaactaacaagtgagtctagtaactgaaacagaaatctgtccttcagctgggtgtctttgagacctaaggaacaacaaaactttcatgaacataaaaatggcaccaagcaattctgaatcagcttgctgcactgatcgcaggaatcactacattaacctcagccagttataggaactgagtgaagcagaaatctaccaacgtgctgcattaagtaaacttccttggaaaactcagagagctgaggaaaactacacaatgaacctttttagattagaatgttggaaaacatgagttcctttcacaacatggggcagaaccctgaaagagctcggggctagttcccaccaaaccatgtcggtcagaaaatatcaatgccctgcaggctaaagaattgtggacaggcagggcgcggtggctcacgcctgtaatcccagcactctggggggccgagacgggcggatcacgaggtcatgagattgagaccatcctggctaacacagtgaaaccccttctctactaaaaatacaaaaaaaattagccgggcgtggtggcagacgcctgtagtcccagctactcgggaggctgaggcaggagaatggcgtgaacctgggaggcggagcttgcagagagccgagaccgcgcccctgcactccagcctgggcgacagagcaagactctgtcacaaaaaaaaaaaaaaaaaaagaattgtggacaagcagagttttttctcttgttaaagtaagaaatacagttattagtcctcccaaatatgtcctattttacagttagtttttgaatacattcaactgagtaccacacatttaaaacaaattaataactagtggaacagatgcaagcaaaatgagctaaagacaattgtcctgattttccttatttaatttcttccactgaacacaaaagtaaaaaacaagtaactgtttgccatctaaaatataacatttttactatcagatattttgcagagttgaaaaatttaagacctaaatggaaacactgaccaactgcctcagaattacttgggagttcactaccaaagttttattggccaggtgcaatggctaatacctgtaatgccaacattttgggaggccaaggcaggtggatcacctgaggtcaggagttcaaaaccagcctggccaacatcgtgaaaccccatctctactaaaaatacaaaaaatgagccgggcatggttgcgcatgcctgtaatcccagccacttgggaggctgaggcaggagaattgcttgaacctgggaggcggaggttgcagtgagctgagttcgcaccattacactccagccagggcaacaagagtgaaactccatctcaaaaaaataaaataaaataaagttttattgaagaagccaggtgtggtgatgcacacttataatcccagttactgaagaggctgaggtagtagtatctagaaatggctatttttatcactcactactaaataggaaagtgagcaggtcttaccagaggcagacatttccacagatcatggcgatggcgttgttccaaccatacactgccacagggaaattgaatgccgtgatgattccaaccaggcctacgggattccactgctcaatcagtgcatggccagatcctgaggacagaaaaaggatggaacatgcagaagcatgttaatttaatgcccatcaagttaataagaacaaacgtacagcagactggagaagattccagatgccttatagtgggaaattgctacacagccatgggatatcagtacattaactaatgtacaacaaaagtggttattaccacactaccttgtaaatcataatgatattcattatgcctctgatcttcataggaactctgcatagatcagagcagtatcagtgcacctgggagacaaggacactttctagagttgatgggtgccctaggtggtatgatcacaaagggcagaacatgaccagggcacaggggcttaggcccatgttgttttgtttggttttgagtcagtctcactctgtcacccaggctggagtggagtggcgcaatctcagctcactgcaactgcacctcccgagttcaagcaatcctcgagccccaccctcctgagtagctgggattacaggcacgcaccaccatgcccagctaattttttatttttagtagagaaggagtttcaccacgttgcccaggctggtctcaaactcctgacctcaagtgatccatccaccttggcctcccaaagtgctgggattacaggagtgagccaccacgcctggcctcacatattctttatgttacctgacgaatccctgggccaacttctctgaattcaagacaaggtggctcatttattggtggaagatgggaagggggagttctaataattatatatatgttgaataaatgaattatgcaggccgggcgtggtggctcactcctgtaatcccagcactttgggaggccaaggcaggtggactcccgacttgaggtcgggagttcaagatcagcctggccaacatggtgaaaccctgtctctactgaaaaaacaaaaattagccgggcgtggtggcgggtgcctgtaatcccagctactcaggagactgaggcaggagaatcacttgaccccgggaggcagaggttgcagtgagccgagatcctgccattacactccagcctgggcaacagagggagactccgcctcaaaaaataaataaataaataaaatgaattacgcaaatctttacattcactataagaaactaaaaatacaaatcagctaggagcagtggctcatgcctacaatgtccagcactttgggatgctgggacgggagaatcacttgagctcagtttgagacttggatcaacatggcaagacccctgactctacaaaaaaaattaaaaattagttaggtgtgattggttatatgcctgtagtcccagctacttgggaggctgaggagaactgcttgagcccagggtattgaggctgaagtgacctgggattgcaccactgcactccagcctggacaacagagtaagaccctgtatcaaaaaaaaaaaaaaaaagaaagaaaagaaaagaaaaaacaaacaaaaatattgtattttaaatacaaacttacaaactttaaagtcacccataatcctacaaggtgtttattttaattaaaggcagctggacagtatagaaccataccacacgaatacgatggttcacaaatcccagttaaaaccacagaccaactggaaaggtggctgtcccagccatcagtctttctagccacactcacactgctagctaggatgagggaccataccagacacagcacctcactcctgggccctccttaatctgggcaccttaatccctagagatgaagtgctggcacagcctcttcctggcagggcctgcctcttcctggcagggcctgcctcctcctctccagccctcccatctctgccctgatgtcacccccttgcttataaccctgtggattttggatacctactgtagctattctcagaataaagtccaatctccttgtcagacaaaatctcttcccgaggttctctttccactctatctgccctaccactgcaccctccagctgtgctgaagcaatgcaatcctcccaaataagccagaccctctcagccttcacacaggcttcttccttctttaaaacaacttccagcactccactccttctcctctttgtcccatttgggaccttaccttggctaaccttctcttggaggccttcctggactgcactcatgaggctgggttaggggatcccagctatgtgcccaccatcctaccgtttactccctcatattacttaccatgctggattatgctggatataattacctgtttatttatctcccactctaaggtataatttataagcttataaatcccttgaggacagggactatgccttatagctcgagtatcacctagtagactacccggcacctgatagatgctccataagcatttattgaattaataaagccaaagttaccccaaagtctctacataaatgagtaaactgctttaaaaaaaaaaatagaagtgtaagctaggtgtggtggctcatgcctacaatcccaacactttgagtggccaaggcaggaggattatttgagccaaggagttctagaccagcctaggccacatagtgcaacctcgtctctacaagaaaaatttttaaattagctgggcttggtggcatgtgcctgtaatcccagctactcaggaggctgaggtggaaagattgcttgagtccaggaggtccaagctgcaaggggctataatcacaccactgcactccagcctgggtgacagatcctatctcaaataaacaaacgaaaatgtgcaagcaattgagaaaaattttaattgttaattgtgaggcaggcatcatagtaggtataaatcaaatagttacctgcttgcacatgtacatatccccaaattggaggtttattgactgtattgttgttattgctgttgttgttgagacagagttttcttctgttgcccaggttggagaacaatggcgtgatctcggctcactgcaacctccgcttcccaggttcaagtgattctcctgcctcagcctcccgagtagctgggattacaggaatgtgccaccatgcccagctaatccgtatttttattagagatggggtttttccatgttggtcaggctggtcttaaactcccgaccttaagtgatccgcccacctctgcctcccaaagtgctgggattacaggcgtgagccaccacggtgggcctattaacttttcttagctagaaaaaaactcttgaaagtgttcaatgacataaaattaatattggataatgggaatcattgctagatatctaattaaggacattaagtgtccttaattagacttaaaaagactcccccaactctttctacaagtagggaatttactcaatattccaagaaaaagagaaaaatatgattttttaaaaaatattatttccttattataaatgtaacctaataaccatcatggaaatttagaaaatgcagaaaaatagaagaaaatccactactagtaattctgccacagagataaccactgctaccactttagcatacacttctatcccaccattgccaatgcagacatacagtcacctgttttgctctatccacattgcaaacatcacaaattgcttacactcttaacctcatttttttttttttttgagatggagtttcgctcttgttgtccaggctgcagtgcaatggcacgatctcggctcaccgccacctccgcctcccgggttcaagcgattctcctgcctcagcctcccgagtagctgggattacaggcatgcgccaccatgcctcactaattttgtatttttagtggaaatggggtttctccatgttggccaggatggtctctaactcccgacctcaggtgatctgcccaccttggcctcctgaagtgctgggattacaggtgtgagccatcttgtccagcttttttttttttcttactcttgctgtcatcttagtatcttcattgttaaaacctcagagtataagattggttcttacagaacagcttgtaatagcaaaacactgaaaacagccctacatatacatcatttggaagctgactaaataaattatagtctctttataacaaaatagatagctgcaaacacagatgaaggaagccccttaatagaataatacgaaaacaatttccagcctgacacagtggctcacgcctgcaatcctaacactttgggaggttgagacaggcagatcacctgagccccggagttcgagaccagctgggcaacactgcaaaaccccacctctacaaaaaaaaaaaaatagccaggtatggtggcatgcacctacagtcctagctgaggtaggaggatcacctgatcccggggatgttgaggctgcagtgaactgtgatcatgccactacattctggcctgggcaagacagtaaaatcctgtctcaaaaaaagaaaacaaaaaaacaatttccaagatatattattgaatataaaagtataaaacagaacgtacagtttgcggccgggcacagtggctcacgcctgtaatcccagcactctgggaggccaaggtgggtggatcatgaggtgaggagttcaagagcagcctggccaggatggtgaaaccccatctctaccaaaaatacaaaaattagccgggtgtgatggtgcacacctgtaatcccagctactcaggagtctgaggcagaagaatcgcttgaacccgggaggtggaggttgcagtgagccaagatcgcgccactgcactccagcctgggcaacagagcgagactccatctcaaaaaaaaaaaaatgtatagtttgctacatatttggctgtacgtgctctaaaaagatacacaagggcctaggaaggtggctcatgcctataatcccagctactcgggaggctgaaggggaggatcacttgaggagagaagtttgagaccagcctgaacaacacagcaagatcctacaaaatataaaaaagacacacaagaaattgaaagcattcactacttccatggggtactatggcttagtcatgggggtaggagggaaacttttaatccttcaaccttttattgctttcttattttctgatatgaatctatcgtttcttcaaaaaaaattaacattagtataatttaaaaataagtaaataaaatcctcccgtaaaagtgtgggttaggggaagacaaccttcacaaacattatttttagtacatgctaatagtctaccaaaattggcttagattttttccccttatgattcgacatttaggtcatttctaatgttttttattgatgccacaatgaacttctttaaacataacttctgtcttatttcagattatttacttagattcttaaaactgggctctttaaagttagagctctttgggtatatttccaaatcgttttacagatgagttaaaagtgtcttacccgtggacttgccaacattaagttttatctttaaaacaaaaaggttcttgatctaacattttcatctgttttaatttgcatttctttgaaagattgaggatattttcacatatttatgccacttgaaatttctcttttgcacagtcaatagccagagtattttattttttttggagctctgtatatcagagtacaaaactcagcttaactaatttcattgcttactttcagaaggcaagataggtcctccaatcatccttgataaaccaacagcatagtcacagatatccacatactcctgaacttcacccacaccttccactaagattttccccatctccaaagacacctagaaatataaaacgacaagcagaatttttccaacagaattcacattataaacattaaattaaagaaagggggaagcaaaacatgttttgtaaatgtaataaactgaagaaagtctgtttcattttccaaagaattttaaaacacaacaattgccttcactttttcctgtctaccttgttaatctttcctctaaggaaagaatttttaaaatatataaagtacaaccgggcacagtggctcatgcctataatcccagcactttgggaggccaaggcgggcggatcacctgaggtcaggagttcaagaccagcctggccaacatggtgaaactttgtctctactaaaaatacaaaaatcagccgggcatggtggtgcacacctgtaatcccagctactcgggaggctgaggcaggagaatcgcttgaacccaggagggggaggttgcagtgagccaagatcctgccattgcactccagcctgggcaataagagcaagactccatctcaaaaataaataaataaataaataaataataaaatataatataatataaattacttttcttaaaaactcttctagccaagtgtggtggcccatgcctataatcccagcactttgagaggccgaggcaggcaggatcacctgaggttaggagttcaagaccagcctggccaacatgatgaaaccccatgtctactttaaaaatacaaaaaattagccagccgtggtggcacaagcctgtaatcccagctactcgggaggctcaggcaggggaattgctggaacatgggaggcagaggctgcagtgagccaagattttaccactgcactccagcctgggtgacagcaagactccatctcaaaaaaaaaaaacctcacaattttatatatagaaaagcatgacagccttattgtccactcaaagaattgtgtatatactacaaaaatactttaccaagcttcctagtacttggatcttctcccgcaaggcatcgccaatctgtcttactatttctcctcgttttggagcaggaatctaagaaaagaatgcaatttttgtgtctgattcaaagcataaattcatgtttataacacagtattggatgtgtgctgtaaaagaacaaattacaatcatatcaaagaagacttttgatcacatcaaaactgtgatatggccaggcactggagccaaaataagaagcaaggcattcatggagcaaatatctactggaaggcacagaggagaagaaaaggcaacaaataattacaaattgccaacaaataattacaaattgccatcagggttttaaagacaaaggaaataaaaaggaagctgagacagagaaaaacagcaagattggaggggaaatgggtaagttactttacctaaaaggatggcaggaggctgggcgtggtggctcacacctgtaatcccaacactttgggaggctgaggcgggcagatcacaaggtcaggagttcgagaccagcctgggcaacatggtgaaaccccgtctctactaaaaatacaaaaattagctgggcatggtggtgtgcgcctgtaatcccagctagtcaggaggctgaggcaggagaatcgcttgaacccaggaggcagaggttgcagtgagctgagatcacgccattgcactccagcctgggcaacaaagtgacactccatctcaaaaaaaaaaaaaaaaaaaagattgcagtggtaacaagggaaacagcaagtggattcacggtctgttttgggagtagaattgacaggacacacagatgcaggaaatgaagagaattaaagaactcaggataacttcccgctctctggcttaaataggtaggtagatgaagtataattactgggatgaagaagacttgaagggaaacatcaggttttgggggtaaagagcacagcttatgtcacataaagtttgagatgtgatttatgaatgagacacaatttctccaactgtgaccatcactccctctctcccatcaagttcttcccaattctgcctctccttcaaagtacagctaaggctgggcgcggtggctcacgtctataatcccagcacttgagaagctgaggcaggtggatcacttggggtcaggagttcaagacgagcctggccaacatggtgaaaccccatctttactaaaaatacaaaaattagccgggcatggtggcaggtgcctgtaatcccagctacttgggaggctgaagcaggagaatcacttgaaccccggagggggaggttgcagggagctgagatcccgccattgcactccggcctggatgacaagagtgaaattctgtctcaaaaaaaataataaagtacaggtaaaaggaacattcccctccatgaaaccttcccccaggcagaagccaatcacaccctccccctaactcccactgctcctaatcacagcactgctcacacttgcctcacagagcttggctgtgagctcaaggttcttccttgctctctcttctccccaagtgtatcactgtctcttagtacagcttctctggatggtcactttgcaatctattaacatttaaaacattcctaccctttgttttatctatttattttttgagacggggtctcgctctgtcacgcccaggcttgagtgcagtggcgcgatctcggctcagtgcaacctctgcctcctgggttcaagtgattctcctgcctcagcctcccaagtagctggcattacaggcgcctgccaccacgcccggctaattttctgtatttttagcagagatggggtttcaccatgttggtcaggctggtctcgaactcctgatcccaggtaatccgcctgcctcggcctcccaaagtgctgggattacaggcatgacattcctaccctttaactaagcagctctgcttacagaaactgagcttatatacataagtatgcaaaagtataggtacaatgatattcattgcagtgctgtttctagtaaagaaaaaaagaaaccaactgtccatcagcacatgattggttaattacggaacagtgataaaataaggtcgatttttatgggaaaacattgaaaagctataatagaataatacaaaacaagaaaacacttatggtaagtaaacttttgcttaaatttggagcaacatataccaagctgttcacaatggttttttgtggggaatgaaattataacagattttcatccacaatttatatgtttgcaatgtctgtcattttcacaacatatgcacacttttggaaacaggaaacaaaaacctgtagcattatatcaatcagcacataacctatacatttcctagcacatggtgtgggtttaatgatgtttcaattgaatttagtcagcacatttataagcttagttaagttggttaatttcaactcagaatggccagtatacatggccttttacctcccattctggacacattttattcagtcagtctttcaacaaataattattgcatatgttctatgtgccagatactgtgctaatccctggatattctactgcaaatgaggcagttacaattcttgccctctatagagctgacagtccatgggggtgataaaggcaagaaacaggcaattacaatctaatgtggcaaatgccatgaaaggggagctagatttcacaactggagcaacctgaagtaggctttttacaagtttagaagtttagggctaagacctaaagcatgccaggtgttgtgaagaggtaggcaaagtggaggaaaagcatggggttagaggggtacagagcatatgcaaaggctgaaaagcaagagaaagtggttttggaaaattatggccgggggctgtggttccacgcctgtattcccagcactttgggaggccgaggcaggtggatcatttgagatcaggagttcaagaccagcttggccaacatggtgagaccctgtctctactaaaaatacaaaaattagccacgcttggtacctgtaatcccagctactcaggagattgaggcaggagaatcacttgaacccaggaggcagaggttgcagtgtgccgagatcgcaccactgcactccagcctgggtgacagagtaagactgtctcaaaaaaaagaaaaaagaaagaaaaaaaaaaacagttccctgtcttcaagaacagagagactcctactctttctcaccagagatgggagggaaaatgaggacacatggggatgcagacggcagaaatgggctacattctgtgctgaaactggctcatggaagaaagcagcaagtctattccttagaaagaaatcaatttctataaactacctttccatatgtttcactttgtttccattttccttaaagaaaaatgttccctttgaaaaattctagaattggccagtcacagtggctcatgcctgtaatcctagcactttgggaggccaaggcgggtggatggcttgcggtcaggaattcaaaaccagcctggccaacgtggtgaaaccccatctctgctaaaaatatttaaaaaattggtggcgggcacctgtaatcccagctacttggtaggctgaggtaggagaatcgcttgaaccggggaggcagggcttgcagtgagccgagatggcaccattgcactccagcctgggcaacaagagcaaaactctgtctcaaaaaaaaaaagaaaaagaaaaattctagaattaactcaaatgaactacatgaaacagtggtttgtcctaacacagtcaaggtcagccaaatggatgagggccaagcagagaagcctcacgtgagggaggatcgagatgggaaagcttctgtgacgagaagggggtcaagctttggtctgttcttaccgagcctctctaagtccctgccccagggaggagccccagagcacaattaggaaaaactctgcctcttccctaaaccttgaactcaattgcttaactcaaaatcaaacaagtaggatccccagctgactctactattacccaggaaagcaacctgttcccacgtagcacccccattctatttgttgggaggtctaaaaagcaccagaagtatgagaaaggatgttaggtgcagaggctggcatggtgggtaagagttgactgccaaatgagatcctgaatgtgaaaatagcaacaaaaaaagtacagcccaatatttaagaaagatcataatgtcagctggcactccctagggcaaagatagatttaaaaaccagttcattccaggtgtggtggctcatgcctgtactttgggaggcagaggtgggcagatcacttgaggtcaggagttcaagaccaacctggccaacatggtgaaaccctgttctctactaaaaaatacaaaaaaaaaacattagccgggcatggtggctcatgcctgtagtcccggctactcaggaagatgaggcaggagaatcacttgagtctaggaggcagaggttgcagtgagccaagatcatgccagtgcactccagcctaggcaagagcaagactcagtctcagaataaaaaccagttcaggaaaagacaagaccctgaattcacataaattctttttttttcaaatgtttgtatttaccctagataaatagacacatacaatagacgtttctagtcaaaagacaacatgttaagttgcactagcattcaaaacaggatatgcaaagagtgaaccctcatgtaaattgtgtactttagtttataataacacatgaacattggctcatcagttgtaacaaaatatgacatactaatgcaaaatgttaataacaggggaaatggcctattacaggcatggtggctcatgcctgtaatcccagcactttgggaggttgaggtgggtaaattgcgtgagcccaggagtctgagaccagcctaggcaacagagcaaaacctcatctctacaaaaaatacaaaaattagccaggtgtggaggaacatgcctgtagtcctagttaccaaggaggctgaggtgggaggattgcttgagcccaggaggtcaaagctgcagtgagccgtgagctgtgagcatgccactgtacactagcctgggcgactctgtcttaaaaaaaaaaaagaagaaaaggaaacttgggaagaggaatgagggagtaatgggaattctgtactttctactcgtttttctgtaaatttaaaactgctgtaaaaaataaaagtctattaatttcttttttcctttgagacagagttttgctcttgttgcccaggctggggtgcaatggctcaatctccgctcactgcaaggtcggcctcccaggttcaagtgattctcctgcctcagcctcccaagtagctggggttacaggcgcgcaccaccatgcctggctaattttgtatttttagtagaaacggggtttctccatgttggtcaggctggtctcgaactcccaacctcaggtgatccgcccacttggcctcccaaagtgctgggattacaggcgtgagccatcgtgcctggtctatttttttgtttttgttttttttaagtatatatgtataggaaggccaggtgaagtggctaacgcctgtaatccaaacactttgggaggccaaggtgggtggatcacgagttcaggagttcgagaccaacctggccagtatggtgaaaccctgtctctactaacaatacaaaaattagccaggcctgccactccgtctgggaagtgaggagcgccctgcccagccaccgccccatctgggatgtgaggagcgccactgcccggccgccccaccatctgggaagtgaggagtgcctctgcccagccacccaactgactgggaagtgaggagcgcctctgctcggctgcccaccatctgggaagtgaggaggacctctgcccagctgccgccccatctgggaagtaagaagcgcctctgcccagctgcccactgtctgggaagtgaggagcacctctgcccagctgcccaatgtctgggaagcgaggagtgcctctgcccagctgctgccccatctggaaagtgaggagcgcctctgcccagctgcccactgtctgggaagtgaggagtgcctctgcccagctgccgccccgtctggaaagtgaagagcgcctctgcccagctgccactgtctgggaagtgaggagcacctctgcccagctgccaccccgtctggaaagtgaagagcgcctctgcccggccgccaccctgtctgggaagtgaagagcgcctctgcccggccaccgccctgtctgggaagtgaggagcgcctctgcccggccgctgccctgtctgggaagtgaggagcccctctgcctggccgctgtgcaaccttccaagtgtgaagtgacagccttgtgtgtgatcttttctgtcttctccaagtttgcatttttgatgttaaagtttactttttaattaaaagttttaaattggagaatatattttttaaaaaaattagccaggcctggtggcgcacacctgtagtttcagctacttgggagactgaggcaggagaatcacttgaacccgaaaggcagaggttgcagtgagctgagatcacaccactgcagagtgacagagtgagactccgtctcaaaagaaaaaagtatgtatgtataggaaaacaacaatttaaaaaaaattatgcagctgggcctggtggttcacgcctgtaatcccagcactttgggaggccaaagagggcagatcgtttgaacttaggagttcgagaccgccctgggcaatatggtgaaaccccacctctacaaaaaatacaaaaaaattagccaggcatggtggtgtgtacgtgtaatcccagccacttgggaggctgagatgggaggatcccaggcccagaaggcagaggttacagtgagccaagattgggccactgcactccagcctgggtgacagagccagaccctgtcttaaaaaaaaaaaaaaaaagcaataactttaggatggtatggaatgcaagcatcacaggtcacaaaattttatacacaccatgtatatatggatgtacaataatcacaactatgaaataaatacatgaaagactggaaggaaatgcaccaaaacctaaacctaatgaacattttgcattgcagaggttggggtaaggggactaaatttgtttatcttatttacagcatcaatcttttctaaaaaaaaagaatatttattacttttatgatcagaaataaatacaagtaagtttttaaaacaatgaaggacactgttttggacagtattctctatccaggtagggtgaactttacctagcacactgtttacttgtggaagtggtatttttctgcccaaggatacttttgattgtgtataatggaaccctaggccatacttctatccataattaaagtagaggaaagatgtgcttcatgctttacacaaagacgtatcttggctgataaaaaaaaaaagcttcatccaacccagggctctgttggacaggctgctactctgcaatccaccccaaccccacccaaccccccttgcaatcactcactcagagaaaatactgcagctcagtagtccctcagcagtcccacacccaacagcacagggtttaactcaaatgtattgaggcttttcctgtgccaggctctccagtaagcactttaaatgattaactcatttaaccctcccaggagacaggcacccccagtcttttctttttacaagacaaagcacactgaggatgggggtagtggaaaggttgggaaatcaggctatcctagttcgcctttactctccccttctcaggagcctagctcccacctagtgacaagtcagtgtggccagcccagcaccagtcacagttcccacatttgctcatttaaccaatggtggagactcagagaccaaggaggctgactctgcctcacagcctgattagacagtcaaggaacatgagcctctggccctgagaaagggatgctgccactgctcttttttttttttttttttttgagatggagtctcactctgtcgcccaggctggatggagtgcagtgatgctatcttggctcactgcagcctccgcctcccaagctcaagcaattctcctgcctcagcctcctgagtaggctggattacacgcgccaccacattcggctaatttttgtatttttactagagacagggtttcaccatgttggccaggctggtctcgaactcctgacctcagatgatccacccgcctcagcctcctgaagtggtgggatcacaagcatgagccaccaggtgcgatctgctgttgttctttaaaccaggaatgctgacctattgctgagatactcccagacaaatctggcagggggatagaggaggagcaaacaaatatttctggcatagatcttctattcattttctatttaattataaattcaagtaatttcagtgaagaatagtgttcacagctcaagtttatactataccagcacaaagttttaattcatttaaatttatccattcaatgaatggcaagtacaaaaaaggcactaccctagaaatatggcagaggtgtttccaaaacagcaggagccctagtacagtatcacagcccccaaggagctcacattttaacaaggcggcactgacctgcttatcagatgtttatgtatctcattggttacaataggcaaagtgatcttttctgaattctagaaacaaaggccatacttacatctgcccagattttccatgcttctcttgctttctttacagtttcttcatagtctgccacactggcctaaattaagaattagggggacagaaagggggaaataaagagaaatgatgatgatcttctagaacacaaaaatattttcagaaaagagttgggaaatctctagggttccctaacatttatggctgagaatgattcccacagtctatacttccaaaaactagctagaacccggtaaaacaggttggtatccaactatgctttaaaaccttgcttttcaaagcaaaatctgtcagcttcatctgggaacatgtaaggcatattagaaatgcagaaccttgagctccaacccagacttcggaaatcagaagcttcattctaacaaaatcctcaggtacttcagaagcactgccttaaatggccccctgcctaatctttctacgcttcaccttttctatggttctttccttttcacgcccccacccaagagaggacagtctcccccagacagtcctaaatgacaaatgaaaaataaacacattattctcttcatttgtgattttatattattcttgacctgcctaactggcttctgcctctaaagaaagcctgcacaaactccttgtgtataatttgaattaaacacacacacacacacacacacacacacacacacactcttacctgtcggactcttgctattggctcgttgttagcagggcaataggtcgtaataaccttaaaacaaaaggatgatgatcatgtatagaaaacgtaatcccttttgaagtaagggaatagaccaaacggggaagaaaaacaagagaggaaaaaatgatataatacccaaactcaaaaagcttaggttaacttctgttacatataaaccactctacagaggttgtctttcatttctgacttaaacattagaaactacctttctgcaaaactcgcctctgacatctcaatattaggcatataaacaaaagccttaacataagcagttattttgtctctttttccattaataacagaccaaactgactagttttagttatttcttctcttccttactctgcccaccctctgctcagagatgaaatggccaaggcaggaaaactgttggaaagtcccgtgtccacaccaactggagaggtctcaggtcaacaatgaaagggaaaatcaaggcacagctaaaaaggcctccaagagcctaatgatcagataccacacggaaatcaggatgaaacaccgaggtctgaggagcaattaaaattatctgtatctcctacagccactgattaccaaaagacgtgttccctctaccaaggcaggttcattatataatatacaacgtccaacaaagtttgttaactgttacataacatcctcctataaaaaactttcttttaaaaaaaaatctgggcgataataaccttacctttccattgtattctataaaacattgttttgagcagtaatgggtatcaggcgcggtgttaagccctgggcaatggagaaatgctgaaaatccagtcctcaaaggagttcacagcccaacgtacaacatggcaagatttcggcacgtccaagcttgcaaactcccaaagaattcaggaaggaagataacttaaaactacactgaagaacgttacctgcggtgcacgtcacagctgaagagccagagttaagctctaaattaagatcagttgcaccgctcagtgtgccacatttctcacaagaccatagatcccaagaccataaggttttaatttttttttttttttttttttttgagacggaatttcgctcttgttgctcaggctggagtgcaatggcacgatctcggctcactacgacctccacctcccgggttcaagcgattctcctgcctcagcctccctagtagctgggattacaggcatgcgccaccacgcccggctattttgtattttttttagtagagacaaggtttctccatgtcggtcaggctggtcttgaactcgctacctcaggtgatccgcccgcctaggcctcccaaagtgctgggattacaggggtgagccaccgcgcccggtagaccataatgttttaaatatgcgcgggaagtttagcccctacagctccaaaatgacgtcgattctgcatagcacacaaggacctaaaatctaagtttttgttttaaaggcaccctacacgagaaaacttttactgtggagcttcaaaatctcccatgctactaccgcatccagcgccagcggggagtcggtaggtcagtgcccgcccggcctcctcgagcgagccccggcggctgcagagatttcttgagcgcccgcgtacctctccccggcctccccagcttccattatacacgccctcgttttcctcgcggagccccagctctttcagccacgcatactggggctgattgatgaggagagtggacatgaaggcggcaggcctgctccaaggtccagagagcttgctggtctttgcagcgtgcacacacagcgcgcgaggaaggcgccacatactgagcccgggactcgggatgagcccaaggccctgagagctgctgaaatagagccccgccccccgcccgggagaacccattgggcagacccgacccctcccactgggcacgaccccgccaccgccccgtctgcccctggtcttccggaggagcctgcggctgaatcctgcctggaacaatgggagtgctac

SEQ ID NO: 1426 - DNA, 53550 bp, Homo sapiens; identical to SEQ ID NO: 1425

SEQ ID NO: 1427 - DNA, 53550 bp, Homo sapiens; identical to SEQ ID NO: 1425

SEQ ID NO: 1428 - DNA, 880831 bp, Homo sapiens
ttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcaggtaagtgatagcgctattatttttgttttttaaaattctaatgacttgtcttatggtttaacagaaagatcataagcagtgtaattttttctggggttaacgaggagacaagcaattttgttttaaaataattgtttctggatcattgtgtgacaagaagaatcaaaataacatacatgttgccttacataattacagtaaacttttagctggccatttttcttattgcttatctaatatctttttggatctggcatatcttgtttattttttcccaaaactaatgcaatcgtttggcaagataattttgttgtcttatgtatgccataaaaagtgatcctgtctgtgttacatagtatgcaagactaaaaaagttaaaatagagagggtttaaccatgccctctaacatattttatattgttataatatactaaactatgcatgggaacaaatacatgtatacatatacaccagatttctcactccatgccaacctccaagtatacctacacctgtaggatcttacgtaaggagacactcatatttttacttagcaccctctttccagcctttgaaagctcaagattgctttctcaaacctgatctgccagaaagcagaaaatgagaagctttagtgtgcctctttaggagagctggatttcaaaatcattctaacttattagttctgcaaaatacatttgtcagtgaaatccagaaagtgatagggaccagtaggttcccgaaaaaccataaactttaaaatgctaattaaatctgttttctgttgattcttatttctagttttcccctggagctttaaaattacaatctttcacagtgaccttgataagcattctgctttaataaaaagggttcactgggcaaaagcagttacacaaatttgtaacccgtgcctgacatttcactaagaatccgatcaattccaatgagtacattcagttcagtgaagagttttgacttgcaaggatggaattttacagtcatgtaaatacatgtgatgagatattcataatcaactctgtgaaaagagtctacccctttgaaaaattacaggagatctttaggttttacttttaatttcactggttgtgtgtaacgatagtaaaatggctctaatgcatatctatacgtaccttccttctcaattttaacacaaaaatcattggaggccgttacagtggcattcattggtggggtgatgtcctcttgttttatgttggctgagtgtagcaattactctgaggaaaaatcattcttaactgtcaccacttaccatgaacctgcttgcttagcagaaaaggagcagaggcatctatgtcactgagctccttgggggctccgttgccctatataggtcaagaatgattatctgaggaggagaaacatgtattattgatttggattccttcccagaaaacctacaatgtgctcttaacacaatcctttttttcctcagtgggagaggtatggaagtgaaattatcacatggaagacttaatcatattttaagagagttacagcatgtctttagacaattattttggctgtcaattaattaacacagagggactcccctagtcagtagggcataaaatgtaagcagagaatgtgtttcaagaagcactcctctgtgtatatggccgcagttccctcctcaggggcagagggggcaggctttctctatgtgtaactgaaatctcacaaagtgaaagttacctttgcctaatcccttaggagatttagtcacagaaatatgtaactctaattcaccccaaactcatgaaactgcatggaaacccttgtcaatccttatctgtagggaaatgtccttacattgagatagagtttgggaaagcaacttaatgcctaccaatgctaatctctaattgtaaagtagatagtcaaacaaacaaacaaaaagggggtagtggaaaccaatcttcattattgcacagaatcacttgtctttaaagaaaaatcaacattttattaagggatatctgtaccccactaagggcatctatttgctttgatagttattttgttttgctaaagaaaaaggatgcatgaggtcttgggagtaccaaacacactatcttttccccattaaaaaaaaaaaaaaagttttattggataagactaagtgttgttggctgttgcttacatttgagactcaaaagagaaaggtgagatgggattacataatctagaaaatgtaaagtatatataggaccagaggataatttaaaatgagccctggaatccattcaattgccttcttccaaaatgttataaaaacacttcttgattaatttttgcatagactatataaatattacttgtatattctaatgtaattattcataccatgaaatcgtattggattttaatgctcacagtttgcctttggagttatttacttgggtttcaatcaagttcaaacatttatcaaaaaatataaaagtaaaaaatgactattgctaatatttagtaattggctgtttttgaccacttaaagatttataaattccaagcagctagcctgcttactcacctagttctgttaagcaacacaaaagccactaggaaagaaaaaagcatattgtaagctagaaattatttccatagtaatctcaccttcccagaaatctgtacagtgtgttatagaatagaattcaaatggagagagatctcttatttggtgttttcttcctatttagcttagcagagtgagcacatagcatgtgttggaagagacaacatcctgtggtaagaaacatgttacacatcatgttgtagggaaacaagtactacttgacagtcaaaagatcagaattttttaactgctggccataagatcttctacaagtcactcaatccactgcagctgaatttttcttccttaaatttggggattctttacttttcaatgaagacacaataatttacatacagctgatacctgaacactcatgagataagtgaatgatgcctactttgtgggatactggaaagtcgaaattcaatgattttgagagtgttttggaaacaagtgttatatctgtgagttattataaataatttccaatagcattcattcattcgtcaaaaaaaatcccactaattactaaataacaggcacatcccttatacttaacaactctcagcatagggaatataatacttccctgatacttcagcagtcatttcctttacatctcttaatggtataaatataagtgatattcaatgaaggtggacttggtttcaaaaatattttattactcagaactgacaccacattctatatcaattggacaaacttagttgacctgagtctatttcaacaactttcattttgaccttcaaagaatctatcatgtcgtgtcataattttctagtttataaaggaggattaatgtttgtcattagtgatattgataaggaaactcatacgatgaaatacacttcaaaactccatatcctaaaacatacagaaagcattgtgatttgactgctggcttgtgagcatggagtgaaatgtggacaacatgcgggctgatctaaggggctagcctggaaatgctgttaagatgttgttttgatttagtcgaaagcctagattttattcataggcctctttaggacatctctttagaaaatcgaataagcagtatttcattgcttatttgcttttcttagtcgggttttaaacgtcactatgattttttcaatgtaatttatcaacatttggtctgtatagatttctagactatcactaaaaatatactgacagtattcttaggaaatataagtcaatgtttggtgttacagttatttccagcattgttttgtggttaaattatataattgcaccagcgataaaaaattatatcatcacttacttagtaatataattcagatttttttttgtcaaatacacacacacacacacaaaaacccagaaacagtcaaaaacataaaatgaaaaagaactgagagtaagaggtcattaaaataatgtcttgaggccagagaatttatctttgaattatccttaaattttcaccgtgaagtttcttcagcacattctacacactgaaagagtcagaaaatcattttgggtctcctgaatttggtcttcaatttgtcagcaaagataaagtgatcatgttatattttttttcaaaaagagtgtcattaaatcaattcatttgaatacttgcttattatcacttcatcatatgtaatgtacatacttgaagatatttttaaaattaaaaattgtgaagtaattatatgctctatgtttaacaaatttactcacaatttcggtctaagatttagttttttaaaagaataagtgcttgcctggtaaattcactaaataagctaatagaaaatagaaatcttttagaaatggtgccaaaatttgaacaataatgtgttacttatataaaactatgaaaaggccaagtacagtggctcatgcctataatcccaacactttgggataccgaggcaagaggatcacttgaagccaggagttcaagaccagcctgggcaccacagtgagacctcgtttcttcaatagaaaaaaaaaacataaaaaataaaaaaataatatctgggtgtggtgaatgtgcctgtagtctcagctactcaggaggctgaggtaggaggatcacttgagcccagcagtttgaggctgcagtgagatataatcacatcactgcactccagcctgaatgagattctatctcaaaaaaatatatatattaaaaataataaattttatttgaatcttttcaaggggtgagaaataagtatgtgagattaagaaatttagatcatagatgagaaaagagtattttatggttaaaaatgcatccagtacacacaaaatctgaggttcaacatggtttgtcatcaattggttgtgtggacttgggtaaatcactttatcttaatttaactgctcagctatatccttggtcctattggtaaatcattattatgtccatgagaaaataaacaatgtctatgtttagttgaactcataaactttccttccacatctgtcatgccattcttcttgaaaatgtttccgtgctctcatggtggaacatacatgggatttagaatcagacttaagttcgaatcctgttatagaaatggcattaatgacaaaaacttgggcaaggaatgtgaagtctctaagtctgatgtccactgcagtgtgttgctgggaacagttaatgagcaaattgtatacaatggctagtacattgaccgggatttgttgaagctggtgagtgttatgacttagcctgttagactagtctatgcacatggctctgatcaactaccgctctctcatttctccagataaatcccccatgctttatattctcttccaaacatactatcctcatcaccacatagttcttttgttaatgctttgttctagactttcccttttctgttttcttattcaaacctatatctctttgcatagattgtaaattcaaatgccctcagggtgcaggcagttcatgtaaggagggaggctagccagtgagatctgcatcacactgcagaaagtgagcccgtcaagagtcctcgactcagctctgctcagttagaacaaaacgtgagaactgaaaatagagaattttgtgtgaaatctactttttgctttacctaatttcattgttaaaattttgcatgtagcgaaacagactacatgctagattccacacatagctgccgaaccttttcgtttcccatttcaatgacatttaatagaaaccctaaactgagatattcagtcagattttttccagacctttttgtttttatctagaaatgagacaatgaaccacgacttgatgaaaaggttcatcttaatatgtttttacaattttaaaataaataaacctaaaaaataatgagtggctgagataaaatagatacttcatgtttttgaatgggcaaaagttttgtggggaaaaattaactcatagaacaaataggaatgaagataggtcaataatattacataatatgttttattccagcatcttttccagctactgtttttgcccctcatacacatgcaacagctacaataacccagataataaccttgattaacagtgagactaagaaaagattattagttattgactaatatctgcaaatatcccttcttcccagaatacaaattttctacttttgtgcctactcatatgtgtaaaaacagataatttctttagaaagttattttttacatttcatcagcaaattataacacactctatagaatattctgttggatttcacaaattggaggcagatgtcttattgtatgttcggtgatgtaagtccacacacccacacaaccgcacaaacacagggatggataagattatgctttggtttgatatatggcaatttttttttgtaatttcttcttttctaatccttgttaatagtgactgtgccaaagggaaaaacaattctgcagttattgatggaaaaaaaggagcttattttgcctaattggtatttgtatattttaatttctttttttgctagaagtgacaaaatcccagcttaaagtggcttaatccaaataagcaactaaataaaaaatatatttgcaaaagagaattactggcttatgcagtagcagattatagcaggtatggcttgattaaagtgttcaaatactatccgcattcttcagtgttgtcttcattccaaagtacggtttgcctacgtgataacatttgcctctttctctgttctcactgtctttctccctcactcctgtctatgtttctgtttctgtctgtctcttttctccccctctcttcttcatctctttctctgtcttactcacctccttaccagttatagttctacagtgtttccttcccaaatccagttcacttcctcaatagttccagtagatgtactgggattgaccaagggaatattacatattgggctggatcttgaagtaggatgggctttacaaaaccacactgattgaggggtattagttattgactaatatctgcaaatattccctcttcccagaacacaaatgactagcatagtgcagttttcagtgaaaggggagactacattaaaggatagaaaagaacaacacttgtcctctacaatgctagtgaagaatctacccaagatttctaagtcactgaatttatctactgctgagggaatactcagcaaaagtgggctcattggcttgttgtttctctaaaagcttttttttcctaaggaaagaatgtcttaagatgaaatgtttgactttaaatgtaattaacatatcaaagttttgtgggtgtccttttactatattattaacaaatgaataatatgaaaaggacacacaagtggattaaaaaatcattggggataaaaaaatagttattccagaacagttattttttctatatttggtgacttttttcagtagttttaaatgatatttccttatttaacacatggtggagcctgttccagcttagctagactatttcccttttgttttcctggtctggttttaatcttgaagaagtaaaactcccgaaagtagattaatctacttgtgtacattttacaccattattatagatgagccaatcaagagtaatacaatagcgcacacttagagtcaaagtaagtcagattgtggtagtttgtccaattcattaacttcataaattaactttatttttctcttcaaacacatctttttctcaacttaagaatccttttaagcgattagagaaaactaaaatatgtccattatctacctaagtcatttgcttttattttccatattgtgttcttttccaagaaatctccttgaagttggaactagaagtttcagtataaagtcttcatagggcataataaatgcatttgggaaaatgtaaccctacactttagtttccgttcgtaatactattttctcacattctatgtgttatacatgattgttagagtcctgttttagggaatctcatgtgattctcacagcaggactaggaagctgactttttcattcctgttttgcaaatgggacaatcaagctccaggaaagttaaatgcttctctatagattaagtcaaaattgagatttaggatcaatatttaatgcttttctattcataagtggtttaggaagaaaaactgcctctcttcttataacacctattataggcttgacttgctttagattgcagtaaataaataaaaaaacaaataaacaacaacaacaacaacaaacagaacagctgaatttcattgactttagttttactaactaagtaactggaggcgtttagattctcaagaatcttgaagggttcatgtgttatcttgatcttaatcttatacaaacagagaggtttttggacagcataatcacatgttgaaagtcatattttacaagcttcagggaaccatggtggaccagagttgattctattgcagaattcagacttgagatgatgagagctggacctaattgggtgaaggttagaaattagcctattaaaactaaatgactagatgttagtgatgccgctatcaaataaaacaagaatcaggaggaggccaaatgagatagtgtttttgtgtactaggtaaatgctcacatatgtaagtgtgaaatacgcttctttggaaggaaagatgtgatatctgacatgggacatgtcaaatggataatgagaggacataacaaccaaatgcaggtgaagaacccattaattttagaaagagggtaaaacctgacctatctaactcagagctaccgaagtggagattactgctaaagctatgaaaatttattagctatttgagagaataaaagaaaaacaattgtttacagacataaatatctttcaaaagtaagaaaaaaataagagaaaagaaggtcataaaagagtcgtagaaagtgtaggggaaaggtataaaggaaaatgcatggagttctaacaaacataccatggttaacagtgttgatactgcacagaagtgaaaggaatggatgtttgaggttcctttgggtttgctcaaaagcagatcacagggcatcctggagagaacgatttctgaaaaacgattaacataatgtttggactgtcagatcctcaagatcaaatcaaggatagacagtagaaagatcacgttcattctaggaagatagtagggatcagaagggattttgtgacaaggaaaaagcactgcagaattattgctgacaatgtgtgttatctcccttattgcttccggtttacagcctgctttagaattaggtgatgctgcatttctgggaatatgagtgctttgttgcatttgatcagatcaggtctgtctgtggtgattaaggtctagtgattggaattataaatgagagtatagtcaaccaaaaagatacacatactacctgggaagacatctgtttaaagttttcttttctccacctcattatatattcaattttaagtgatcatgtaaaatatgcataaaatatacacataaaatagtcaatagttgctcatttgttttagccactgagaattgactgagttctccacttggaacatgtaaggtagtgttgactttacttgaaaggctgacatccatttcagataacggtgtctctttttattttatcatcctattatattctcttctacgtgatttgccttctctgcttttcatgttgtgtaaaattttcatatttttctaaaagaaattttggagcatgaagaatgcatacaaggggtctgcagacccatctaaactttgttagtagactttatatctcactgcggctcaatgacctggaagataaactggccctgtctgttccatcagaacaacaggaatttcccgagttcaggcaaacagaagtttgcttttgtctgatactcaaatttctctctcaatcactcagattctccagataattgcctggcttttttcttggtactagaggagtgaattatctactttctggaggccaattaagttttctaaaccactagtgggcatttcagcaaattaccttttcagtgcactaaaaagctcctcagtaacccaaaagaattaatgtaccaccaaacagtgggcaatttattccctcaccactgatgagggcagacagtttagagcattaatgggagcatttacattgagtcacagtgaagtatggagtcactgagcctttgtgaagctaacccatggagggtgaggaggtgtttatcactgtggagaagggaggagggacaaaggagatgatccctacccttaaaagctgtagataatgctgtcagccattatctggatggaattcctatatcatcatctgtatatttggcaataataggcaagttaacaacccatggtcatgaataattatctggttttagagttgtataaaagtattctttgtgaaataatcaaatcttttattttttcatgtactgaccattgctatttttatcctggtcctgtttgtgaaatgggataatttatttctgtcaactaaaaaaatcaatgacttggatgtaaatgaacctactacatgtaactggttttggttttaactcttctcctgtttttctccataaatgtactgataaatgtaatgattcgtgtctactttattaattactgctatttcctgctgtggtagatattccacctgaaatatctggaaattcaactgaaagaattgtttaaggccctttttcttaggtctcatgaatcatatttcaagcaatatatgcatattactacataccattctaccgaataactcaaagatatcccaccttgtttttaggagatattgtcaaaaacactgacaaataccaaagatttcctagtcatgcttacgaatggataaaattgtttggagaactaaacaattctactatgtataattcaatgttgggattttgttaaaaaataaaattccttcaaatcttacccaatctttatttctgtgaaacatttttgggaggggaaaatatggataaaataggcctaatagtagaataatcaattaaatgaagcctagaaattatttacattatttttataagcatataaagtcttcaatagcctattttcttctgaggagaattaacaaaattccaaatgaaatacagtctcttccttcaatgtgtacttccagaacatttgcataagatcttcactgtaatgaagccaaattactcagccttttcacgtttataaaggatacatgttaagacattgagtcctaggaggaagatggcacttaaatacatgaaagttttgagcatcaatctcagactatattataactgctcctaatgaacatggaatttaaacaactggaacaaatccaataaggagaaaaaaaaaaggcttggcatctgatgagttacttagcatatctttttgtaaagaataaaagctctctggcttccaacaaagagtttgtgagctgtatggcagtgttttgaacaaggagatcatttataaatgctgtctttatttgggaaataattatgggatgcagctgcaagttttaatgacttttaataaagtatgttataaagtgaattagcaataaatatctaacagatgatactgaatcaagacattaaagaacatcattagacctatatcttggattgctaaagcaataaatgtgtttttgttaataccagtggttttttaattttctaggacattctgaaggaaattttaaggcaggttaatttttaatgaatagggttagtctatcaactagctctgctagcccagtacaattttagatatgtaactaatagggtatcaaagctgaaaactcttaaatttcaacaatatatagaattataaaataagtttcaccggtagtatctgaaaatacagtatttcagccacttaaattattatgactttcataaagaaaggtatatgtactttatagaggaaaaaaagtttgttagaaaatctgtgttcaacacttgctttgctggcattaccacaactaaatttcaatgtcaggtggtcagaataccaatgatcaggggcaaatacagataataacccacacttcctgtttgtacaagtattactatgccacctcagtatgcagaataatgcagtaaaaatttgttttaaaaaccaagtttagttaccaacctccagaagtgagcagagccgggctaacatagcattgtgatatcactataagctggctttggaaatgtactcacagatgatcaggttaggaagctgaccctcagaatgtctgcaatttgtttcaagtttcaaatttagtttatgagggagtttagacattaattatgttttatttcatgatgatactccaaaaaggctaaagaaaagttgaataatgtttaatgggtacctctgtatgtaaccatagttcagggcaaatgagcaatctaggatgctgagaaacaagagaagaggcaagttgtaagtcttgcttgacttctcaaatgatattcaatcatggttgaattcccttcgtagatgcagctattggccaggtgtagtggctaatacctgtaatcccaactctcagaaagtctgaggcaggaggatcgcttgaggccaggagttcgagatcagcctggacaacaaagtgagacccccccatcactacaaaaagtaaagtaattatccggatgtggtggtgtgtgctggcagttacagctactcaggaggcagaggcaggagaattgcttgagcccaggagttcaaggctgcagtgagccataatcataccactgcattccagtctaagcaacagaaccagtacctgtctctaaaaaagtaaataaataaaataaacaaattacagatgcagctatgcacagttatgttatatttaaataattacttgtcttttaactttttactttaattataaactgaaagaaggttgcagacataaatttctcatgaaaacttctccaacttccttcatgataacatcttacataattgtaatacaatacccaaaccaggaattgatattatacagtattgacaaatacactatagccttatttagatttcaccagtttttacctgaactaatttgcctgtgtgtgtgtatctgtctgtctgtctgtctgtctgtctgtcgctgtgtgtgtggagttctgtgtggtttatcccatacatagatttgtataaccactctcacaatcaagatatacaactgttttagcaccacaaataaacttccttggtttatctggtacagtgtgattcacacccagctaccctggaaaccactgttctgctctctatctctacaattttgtcattttgagaatgttacataaatggaatcatatggtatgtagcatttgagatccattttttgcactcagagtaaactatccaagttgttgcctgtgccagtagtttattcattttaattgctaaatagtattttgtggtattccagcttttccaatctgtttgctcatttagtgattgaaggacatttaggttgctttcagtttggggctactgtgaataaaggtgctatgaatattcatgtacaagtaattgttattcagtaatagagaactggaatatctccctatgagcacacttgatcacttaataggacgtaataacaatatattttgagaaggtaggtagaccaggtactagagaatgacttgaatcggtcatcctaagttttaaactctggttttcatgggtgggtgatggttttttactggttgccttttctctattagtttcagatatataatactgtaaaacaataataaggttctagaaattaatgtaaaatttaaacaaatcaataaacttcccacacaagtatcgattttctaagaagaggttctaggtaatgtcatatttacttgattttataattacccatatgttctattacgaaaaaataaataggtttgtgaaaggtaacaaaaaatctacacacaatttgtacaagtataatttttttacaatttatattttttagaagttcacaaatatatttataaaaactggagcatatattgtgccataaagaaaactatgctgaacttcaaatgattaaatttcaaacaccatgatgttatatcaatacaatttaattaaacataaattaattaaaaataactagagtttttcaacaaataaatatgaaacaactgaacattcacatgcaaagaaaatgagtctagacatagaccttaacagtattgacaaaaattaacttaaagtgaatcattcatccaaatgtaaaattcaaaaccactaaactccttgaagatatcataagagaaaatatagatgacctttggtatggcaatgactttttggatgtaacatcaaaggcataatctttcaaagaaataattgataagctaaattcattaaaattaaaaatatctcctctgtgaaaggcaatgtcaagagaataagaagacaagctatggaaaaggagaaaatacttgcaaaggatatatttaataaaagactgttatttaaaatatacaaagagcacttcaagcccaacaataggaaaataaaccaaccaattaaaaaatcggtaaaggaccttaacaaacatctcaccaaagaagacatgcaggtggcaaataagcatatgaaaagatgctcaacaccttatgtcattaataaattgcaaattaaaacaacattgagatgccactgcacaacaaaaaaattagaaaattagaatggccaaaatctaaaacactgacaatacaaaatgttgacaagaatgtggggaaacagaaacttatccattgctggtagaaatgcaaaatggtagagccacgtggaatacagttggggacttttttacaagactaaacatactcttagcatacaatctagcaatcacacttgttgttatttactcaaattatttgaaaacttacgtccagcaaaactggctcaggaatatttatagcaactttattcataataccaagcttggaagtaatcaaaatattctgcagtaaatgaatgaatacataaactctggtacttccaggtaagggaatactaaaataaatgagttaaaataaatgagttattaagccatgtaaagacatggactatatgtgaaatatatgttaatattaacttacttaagaagttgagaatatattttaaatattaagttacttaaatattatggtactaagtgaaagaagctaacctagaaaggctacatattatattattccaactatatgacattctggaaaaggcagaattatggagacagtaaaaaatataaaaatcataataaattattgattgccagaaattagggggagggagggataagtaggcagagcatagatttttatcacagtaaaactaaactgtatgacactataatagtggacaaaagtcattatatgtttgtccagacccacagaatgtacagtacctagagagaaccataatgtaaatgatggactttggggctgggagtggtggctcaagcctgtaatcccagcactttgggaggctgaggggtcagatcacaaggtcaggagttcaagatcagcctagccaacatagtaaaaccccttgactactaaaaatataaaataatagtaacaaaaattagctgggcatggtggcgtgcacctgtagtcccagctactcggggggctgaggcaggagaatcgcttgaatccgggaggcggaggttgtagtgagccgagatcacaccactgcactccagcctgggcaacagagtgagactctgtgaaactctgtctcaaaaaataataaataaataaataaataaataaataaataaataaaaataaaaaagatggactttgggtgaagatgtgtccatgcagtttttttgtttctttttttttgagacagagtctagctctgtcccccagactggagtgcagtggtgtgatatcagccgctcattgcaacctctgcctcctgggttcaagcgattctccagcctcagcctcccaggtagctggaactacaggcactcaccaccgtgcccagccaatttttttatttttagtagagacagggttttgccatattggccaggctgctctcgaactcctaacctcaggtgatcctcccacctgggcctcccaaagtgctgggattataagtgtgagccaccgcgaccggccagagattcttagactgtaataaatacactactctgctggtgtgcaacaaatgttgatagtaggctaggttgtgggtgtggcagcgcaggagctatacaggaactctctgcacattttgcccaattttgctgtcaatgtaaaactgctttaaaaaatagtatatttaattttttaaaaattagaaaattttcttgtttgtaaaattaagaaatacttttccccagtgcaagaaaaaaaataatattttttaaatcagaaaatattttaaacaaaaaagtaataaaatgttatacatatgattgtttaggacatgcataatttataagtaattctctagccttaaatatatttttggaaagaaacaaagaataaagatgactaagcatccatgtcaaaaattttaaataaatctaaaaataatcacagtggaattggacaagaggctataattaatataagaatgtaattaatgaaaacaaacacaaacgtagtataggaaaacaaagaaaaagctggcttttcaatagatttatatgtgaacaaattatggtaggacatcaagaaaaagggaggacttaaataactaataaagaaaataaaatcaagataacatttatttaaaagttagtagtatattgacaaccacttcccatcaatattttagaaattttattttcaacttataaattcctagaaaaatataattcattggagaggaaaggatgaaagcagggggcatgggattcattcctctcctgaggacatgataaaggccagtgactcatctgaatctcttcctaaatatgcagccactggcctcttactcaatggtacttgctaggcggagaaggcaagcccgcatctatgtagagcttgtgcaggccatccctgatttaggattgattatgggttccccgaagaatgtcatagcaacgatgcaactttctgggctgtgaaatggaggtcttttgtgaggtaatctgtgcatcccactcagggacatcctctgacccagtgagtgaggccggaaggacgcacctggggggctgcccccctcccatcccagcctgtgctgctgggtgacaggtgtcagtagctttatcagggaggcctgacactggatgagatccctgaatcacggatttatggttgagcaactcagccctttgttttagcttatttttttttaattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagggtgatattccccttcctgtgtccatgtgatctcattgttcaattcccacctatgagtgagtgtttcctcaagaggcagaaaaccaaaataacaaaacaagtaaacaactaaaacaaaacaaaaccaaaaaagccttataggcattgaagtaataatttaattgttagaaaaacataaataaactacaagtccagactgcttcgaaaacaatttatactaaatagccaagaaaaaaatatcttggagatgaggacaaaaagaagtctcccatgaactttataaggttatcaaattttgaatttaaaacataacaagagatagtatgagaaagacaatacataaaatagaaaaccacatccaggaatagtaaaaaaaatcattcttggtgccttttttacatttatatcagtgaggcaaggttattctattcaaaaagtaataaagcaattagcactattaatagattgtgagaatcatactataacctcaatatatagatttttattaactaattaaaaattattcaaattcctgataacatctaataatctagcaatctagaaataaaagaggactttcttaatctgatgaaggagatatataatatatatgtgtgtatatatatatgtgtgtgtagcatatgtacatattatacatatgtgtgtgtatatatatatatatgttacagaaaccatcattctttatttatatatgttggaaattttctatttgaaaccaggaacacagtaagaacaccagtaaaaccacttcctttccatattgcattgaaagtcttttccaccacagtaagcacattaacgacaataactgacaaacattttaattgttagaaaggaatacaaagacacctgccatactttccaatatttgcacacagcgatgctcccaaaatttataaataagatattagtaagaacacttgaaaaaatgctgcatgaaatatgaaaattaaaaaataaactttgtttagataccagcaatatatacattaacacatctatagcaaatgatacatataaaatagacaccttttaatgtcacacaacaattaagaatgatcaaaaagtaagcctacctaaagcaataagaaaaagatacatttcaaaggcaaaaactattaaaagactttgcaattccccaaagaggaaacccaaatgttgcataaagaaaaggtgttcaaccttactgattctcatggaaatgcaaattaaagccataaaaacagatagaccaaacaaaattactaaatgtaacaagctctgatatacatgcagagcaacaggaactctcatattgcaggtggcagagtaacatttacaatgtggccgaccaacagtttggccttatttattaaattggaatatccacatatcctataaaccagggactgtaccctgaagaaacccttgcacatatacacctaaatacatgtgagattcatagcagcatatttcataaacaagggaatcatagacactgtagactactagagggaagagagaagtgggggcacaggtggaaaaactacctattgggtacaatgctcactatctgggtgatgggatccgtaacccaaacctcagcatcgcacaatatacccatgcagcaaacctgcacatgtaaccctaaatctaaaataaaagttgaaatatttttaaagtgtgaaaataacctagaagtctatgaaaaaactaaccaaaaaagcaaaaataacctagaagtttataaacaaactaacaaacaaaatcaatatcggtatgtattcacacactagaattccatcagcaatggaaatgagaggatgatggctacttgctcaatatgaatgaatgtcgcaatcacaatactgagtgaatacaacaagatacaaaaggaaaagaacacattatgattccattcaaatgaagtttcaaaactggcaagaaatattgtttttagatgtatagatattaagtagcaccatggttggaataagatggcttctggctgaatgagggaggttatgagattctggcgatattcactatcttcatttggacagtcattagtagttactagctttaaacacataaaagtatacatatatattttatgcattgtgtgtgcttaattttttataattaaaggaaaaaagttatacaattgaagcattaaaacaggacagtaagtcctctgctcacccttccccatttcatgaagcttcaaatcccttttgtggaagagacacagatcactaaaacaggtcagttttacttcaaccactggtgcttactcagttttctgttttagttcctattacagcttctaaaacatagtaagtgctcaaacacatttgttgagtgagtgaaggtctaacattttaaagaaaattaataacttttgctctgttgtttaatcctaatgcaattctatttacttttcttctaactttttatttgaaaaatgtcaatcttagaaaaaaattgaaagaacccacaaagtgaacacatataatatcttcactgagatttattaatattaaataatattgaacattattattgaataatatataactttcattattaatgtccagtgtcgtattattacacatggtttctatccatctcaaactagtcattatgtctttaaaaaaaaaatagtcagaacgtatttaatgacaatttatttgatccctgttgtttttttaaaatacattgagatataattcccataacataatacttaccctcttaaagtgtataatttagtggcttttagtctatttacaaggttgtgcaaccatcaccactatttaatttcagaatgtttccatcatctccaaaacaaactctgaaacattagctgtcactcctcattctcctttcctcccagaccttggcaaccactaatatattttccatccctatggactttcctattctggacatttaatataaatgaagtcataaaatctgtggtcttatgtgattgacttctttcacttggcatactgttgccaaggttcatccatattgcagcatacctgagtgcttcatgctttttcatagatgtataatattccattgtatgatttttttaccacgttgtatttatccatttattacttggtgaacattttgatgttcccacttttttattattatgactaaagctgctgttaacattcatgtgcaagtttttatgtgaacgtatgttttcaatttttttggatatatatctagcggtgcagttgctgggtcatatggactaacatcatgaggaaccacaaaactgttttccaaagtagctgtacattcccaccaacaattcatgaagtttccgatttttcctcatcctcgccaatgcttgttagtgtctgtcttttttattatagccatccgagtggatgtgaaggggtaactgactctagttttaatttgcatataattagcgactttttgatgcttatgattttggtgtcacatctaagaaactattgcctaacttaagagctcaagattcattcctaaattttcttctgagaatttaacagtttagcttttccatttttgtctttggtccgttttgagcaaacttttttatatgccatgttgtagaggccaactgtatttatttacttatttatttagttagttatttttgcttgtggatttccagttgttccagcaccatttgtttaagaagctgttcttttctcattggatgatcttagcacattattggaaatcaatttgctataaatgtaagtttttgttttttgaactctcaattttattccattgatgttgatgtccagtctcatccaaatattacacaattttattattgtacctttgtactaaattttgaaagagatgggtgtgagcccattcacttttattcaacctgtttgatgcttattaattcatgtgatgcatatttattggtaacctcctggacttggttgtggaggtttggcagggatatcgctacatatttatggtctctgcttaggttaggaataacgtgggaaagggaaaaggcataaatgtgaaaagataagtaaacctataatttatatccaagatgtttctttctttctgtctctcaacaaattcataacagaaattaaatactctgagaaggaaaagtgaataaatagtacaatctgtgagatgagtgtgtggacgtaagtctcttatctagttaggatgtctgggctgctattcaaaacataaacctaaatttgactgggttattctctagtctttataaggtataccttacttaaattgataccttccctgattacacatacctttccttgcagcaagcatctttcctggccatgatcacctctcctggtcatatatactatatagatctatctatctatctatctatctatctatctatctatctatctatctatctatctactcaacccacctatctacctatctatttatcatatcatttttgtaatattatcatgtagactttctttgagagaaaatataatagaatggtattttcaaattaggcaattcacaaagatttcagccaattttcaattcaatataaaataactgatgcaaggtgaaaatgctatgataaagactaatgcgaaagtggaagagacctcagagagaaggtgggactaaattactcactggaaattatacccctgaagagtatgtgtttaatgatagagtttgctctggaatgtgaaataattgcaaaataaaggtaataattgccattgtcatgattatgtcgacaagtcctatgacatttcatcaaaaatacagatgcaaatataagagcaacatgtttgtgtatgcatgtgaaaacagtaccatgtgtgaacaagtaaataagttggtttaaaatctaatctccataagaaaatatgggtttcttcatgaaacttccatcagcaaaatagctcaaatgggataggattagatgagcaacctggagaaaaaaaaatgctgaaacaaaggaattgtttctctttgaatttgtgagggaaaaatgttaaacatattttcaaaagaaactattatttatcttcatgagaaagcataataaatcaatgccaatgctgatttagcaccagtaagtttaagccatcccgtaccataaaggttgaagaaggcagaaaaggtgttgtctagatcattggttaataaaactgaccaaacagttgtaggaagcatttgaaagtatgaatttaagaacttattccagacttgctaaattttaatcttatctgtggaatgagacagcagccaagcagaagtgtgtgtgtgtgtgtgtgtgtgtgtgtgtgtgtgtgtttgtgtgtgttaaagcgcttctgaatgttccgatgacatcttcttagaagaaatgtttggagagcaacctactccgatgaggactttgatgcatgtcttaggggattcccatactatttcactcacaaagggcccccaaagccattaattccttttttttttttttttggtgtcaagcacaggccttcaatgactgcagagatgcttaggaagaattttacaaatgggaaatgctgggtcactggaaaaaaagtggcttcatgtgaggaaggagatgtaaaccaaaaaaaaaaaaaaaagaaaaagaaaaaaaaatcatgcagcccaggtgactctatccaaatgcacaccggctcccattttcccagccctggttaagacagacaggagaaatcaaacaaaggtttgtagaacccaactgatgtatgctcagccaggacatctctcctgtgctcttggcacaatcctttgtcaccagcctgcagctctggcccagtgttggaagccagatttccccaaaccttggcaactgcaaaacccaacactgcaattcacctgatagcctggcagatgtactcacttacagtctttcaaatttgtatcctaacttcattctcccttcatcttccctattggactatgaggtataactgtgccttttctattttttaaatgctcggctgcaatatctgcgatcttccctctgacatggatagcagtgaactctggcatttacattttaaagggacgaattgattatgtgaaagtgaatccaattaaaactaattaaagttgaaactaaaaatgtttatgaacactgaaaaaaatcctaattggaatggttcacagagagacttattcagcaattgttgagtttccaatatgcaaagaactaggggtcattgcaaactagtggatataatttaaagggcttagtgcaggcataaggacccttaacagagttaaccaaaatgttgtcagctgacttaacgccttttaaaaaataaattttataattgatttagatacaaagaacattttccttttttttaatgtggctcctctatctgctttgaaaattcagtgtgctgaaagtgtcgaggtcccttttgctacagtttccctgtttattaatatgagttcattttatagggaatctgaatataaacaactcgaaattttagagaattatggtggaagtatcactcacgtttggtaactaaaatacaaattgtcaaattggttcaaataaagtaataaatatatcaagtacttttgagaatgaaaaatataaaaaatgatttcctccagaaaattcactttggcactatttatgcttttttacaatatgctctgttttctgcaatttgaaaaatgtgtcactattatgtaaaattcttcctgccacttactcattccacttcctgacttttctttttgtacccaaatgttcatagcacccttatctagtcaaaattagaaataacccaacagtccatcaacaagtgaagagcaaacatggtacatccacacaagggaactttttcaagcaaaaaacagcaattatgtattgaaatacttattgatacatgcatcaacctagatgaacttcaaaacagttatcctggctgggtatggtggctcatgtctgtaatcccagcactttgggaggccgaggtgggcagatcatctgaggtcaggagttccagaccagcctggtcaacatggtaaaaccccgtctgtagtaaaaatacaaaaattcgccggacgtggtggcactcgcctgtaattccagctactcaggaggctgaggcaggagaaccgcttgaacccgggaggcggaggttgcagtgagccaagatagcgccactgcactccagcctgggggacagagctagactccgtctcaaaacaaacaaacaaacaaataaacaaacccagttaggctgataaaagaagtcagaccaaacaaagggaaaaaagagtacacattatatgattccaattacataaaattctagaaaatacaagctaaactatagtggagtggatcaggagctgcctgggacaggaagaagcaggaacgtcaggagaaagggatgacatagaggcctgcggggacttttaggggtggggttcagcgtgctgataatggcaatggtttcgaactatacactttaaatatgtgcagtttgttatatgtgaattatctccataaagctgttacaaaattaattctggctttttatttgtactgtttcaaggtgaactagaacatttaaaattctctatgtagctcacattacatttctattggagagtactgatggagatctaactatggtttttcaggaaatatgaaggacaatgaaacatgctaaccacaccactgggatctagtcagctacactcaaaatgtggaaaccatagtgaacaaatgattaggcttttttcaacaactaatgacaagggaaaccagaggtaaaaagggtcatgtgaaaaataccaaccaaatgcaatgtgtagcttttcagactgtgattttacatttccttttagagttattcagctgtcttggaggcagacagttttcttttctttctcctttcctctcttctttcctgccttcctccctcctccttctgagttcctttttgaaacattattcctgtcagatccacaagctaatatttttggcatagtcattgacttgtccctcccttcttttctttatcctatcagtgatcagtcttaaattcggccttgtccttatctttgaacctgcctctcccttccctggctacaaaagtagcctcattattggttccctgactcctttcaaatccatgccatgccactctgtcttattttctgaaacccaaattctaatcattccatgaccttgactattaacctccattggctacccacaactgaccatgtaattccttggtgtaatttgtaaagctattctcaagctgagcccaattgtctctcgaatctcatatatgatcattgcccatgatgtgttcccaaataacaggatcagctcagtgtgtgccaagcattttgcatgccttagctaatttaatccacataataatcctagaaggtagataataattataatccccactattttgtagacaaaggagcatgtgcatgtttattaaattggatactcaggatgaaaatcatcactacatagacaggattcaaattaattgcagggctatactattcttccagtgccaaaaggtgcatttgtggaatttctctttgtccctccctatcttaccatgccttcttttcttttgttttcttttcttttcttttcttttcttttcttttcttttcttttcttttctttctttctttctttctttctttctttctttctttccttcctctctctctctcttccttccttccttccttccctccttctttctttttcttcctttctcccattgtttcttggacttcataacaagagtttatttttttcctatgaaaatataaatttaaactagataacatattttgactgtgtaataaatttgtacaaattgtattaaatttcaaatcttgttctagatgttgctcttttccttcagcattatgtttgttggaaatctcaccatgttgtttctgaagctttagttcagtatgtgtaagtgtttcatagtattccacagtggtgccctatcacgttttaccagtctgtctcctagagatggattcttaggttattttcaattatcagatactatgcatagtagtgaaataagactttaggatatttcactgattaacttatgagtgtgccgattcaaaatgttttcacattttaaattttatttagtactgcagactgtttttagaatggccatttcaatttatacttactctttccactagcgtgttaaaatttctgttctctaacattctgtataaactttggcattagccaccctttaactttaccgttctaatgggtataaattcatatgttggcaactaaatttgtatctgtattactactagtgaatgtgagaatctctttaattttctttcaaccattaggccctcatctatagcttgtctatttatagtcagttgccaataaatagtttaattgaataagacccttgtcattgaccacttagtatacacaccacaaatgctcacttaataaaaagcaatgtactacactttgtttgttgttgttgttggttttttctgaaacagactcccactatgtaaaccatgctggtcttgaactcctgggctcaaacaatcttttccactttagcctcccgagtaactacaattacaggtttaggccaccgtgcctggcctgcttattttgtatgtcaaattcctgctatgtcttttgagttggctcagttaaccatgggtaacaaggcataaaatgaccttttcaaactattagtcattaagccttttaaaataaccaaaatgaacaacttgttctctgtggtatattctatgtttagcaaaggcccaccctcaatttctctattctgctagaaagcattgggtttcagaagttctaaccatgggcttcttggaaagtcagcagctcctgagaggtctagggtctagcaggccgagagcatctcttttctgccttttacttaaaaacgaaaaatgaggaacaataaaatatgtggagtaaaatataagcaaaactgaaaaagtcttatgatacacagtaataagataatacatgagaggatatttgaattcgacatagcatgagatgatttcttggcttctgggagttgactccatcaggctttggtctgtataatctggagtctgtgaaatttgaggtgcttgggttgaacaaaaccaatacagagaaattgcacactgagtccttgaggtggcaggatggcacaaaccaaatgccctgaaagacctgggaaactgcaccaaaaggtagtcagctaggtaacatgcaccaaatacattgagcagggatgtgcaaaatgcctcgaaagacagaggatcccagcacccaggcggtattgtaatcacatatctgaggaatggctgtgcccactcttggggtgggtggtggttggttagcttagcgaaaaagtagattttcctgggaaatactgtctcagtgaaaaggggaatggctaattcagtcacagtggcaggtgtatctttatttctacctgctttatctcttaacttgattatatacaatatgaaattcatgtaaaaaaatcctttattttgactctgttttttatgaagcaaactttcataacatttggcttcctctcaggtttgctcaaggagagacaatgtgttcaacagatgacatttctgtacagtctctttcaccaaatgacgttttgtaaatacttattgaggacctaacatgtgcccaatattgtactaacaacagagaactcaaaacagttatgaccctgtcctcacagaacttgtagtcagatggtagagagagataccaaatattaaacacagaaatattgaatattttaagtatgtaatcatacatgtgaaaatagaacacatgttgcaaaaacatcatgagacaggatactgcttatgtgaatactttagtctcaggggtcaggaatgactgctctgaggaaatgatctcttagctgatattctaagtttaaaaaactttaactgataaaatcaacatatgtttgatggagcaacgtttaaggcactgttggaacagcccttgccatttagagatgggaacgtggactggactgaattcatcaataaaatgcccctttgtgggatgcatctgagtggggcaccccctcttctcaggacaaactcttcagtcctgtagcactctgcattcaagctctgacaacgcaagagtgggtggtttcacaaaggggggtttccctttgaccctttccctgctttctgtccaaaaaatatgaatataacaactccagcctccgtgcagttccttttgaggagacttaacattgctgaagaggttgaacagctcccttctagaagagccaccctcttcccagaagaagttgtctttatggaactcctacacctttaaggctcaccagaatggtcacctcacttataactgatattcagaatctgatatcactttcttctgacttttcctctgaaattcattaaacaaatgtttatatattatatattatattaatatatatttacattaatttatatacattatatatttatatttatatattatatatttacattaacttttatatatatatatatatgcatatttgaaatggctctgaagctggtcatggaggcctttgcacctgcttcaggttcatgggcagcctggcctgcggcctgagtgagcccctctgggctctggctgcctgcctgccttgaagtctggctgatgttccagctggaagcctgtgtcacattccactagcagatgtcctgaactctgggataagtctctaattgaagggtaggaagctttctggatagaggttggatttgtcattctaatatatgttaatctgtctagaaggatataaatgaccttttctctctcgcttttaccattttgtgtttatttacttgtttttagattaatagattttattagtatgcaagacctactgtgaacattgcactggagtaaaaatttcgagaagtgttcagacatatgttggtcatatgtttgacatgaaaaggtatacaatctagtggcatatatgagaatgtacacaaataattagagataaatatagctcaaaaagacaaaagggaggaagggtacgctaaatatagactaggacagacctgccttttcaatctgaacattagtagagaggagtaaaggtaatattgtaaaccttgcccacaaaatctgataagaagttttctgaattgatgccctatttgtcttgactgagacctacccaggactgaagacaaggaaaaatttactaacaagtaacacaactttcatttgcatatcactttccagcttacaaagctctttatagacaacatatttctttttcaaaataaattttattttttgagtagtttttaatatacagaaaatttgcaaatgtggcacacagagttctcaaacaccccatatgaagtttcttttattattaacatcttacactagtatggtatattttctaaaattaataaaccaatatcaatgccattttttttactacagttcctacttaatttaagttttcttagtttttatctgctgttcttttttctgcttcaagatcccacccaggacaccacaggacattttgtcctcatgtctcctcagcctcctcttagttatgatcatttcccagacttcttttattttcggtgaccttgagagttttgaggcataattgtcagatattctatgggatgtccctatattggggtttctttgatgtttcaagtatgactagattgagtttatgtgatttgaggtggaagaccacagaggtaaattgccatttcattgcatcctgtcaacacaacgtatcaccgttgatgtggacttcagtcacttggctggggtaatgtttgtccggtttctcctctgtaaagttactttcccttgcactccacccacctccatactgtgctctttggaaaatagtcactatgaggatttaggcttcatctcttgagggtttattatctacaaaaaatatttgcaatttctcttcataagagatttgcctcctctccaccatttgatgttcaaatctaatcattcattgtatcagtatgaactcatggatgtttattttgtaatttcagtcataatgcaatactcctttattttgttgctcaatatgtttctttaaaaagtatttaaatccaccctgttcaaaaagaagttgggagtgaaagaacgtttcagaaaggtgaggtgatttgccaaaggacacacacccagggattacatccaaattatggtactcaaaggctgtattccttgcttacaaaaagggatccttcgatctagtggagaaactggccaattaaagaaagaattgcaaagtgggtgcttgcagtataaagatgaaatgtatgttctagtaactattggtaaatactaagcactaagtacaagtgctaatattttaggataatgttaatggcttcacatctctgaaactgctattgttcttcctgaaacagaacaaagaggaacagaatacttgttcaggctaggagaatggatttaggatacaaggtatgagtgtggaaggatctttttgtctgaaggcttgagaaaacatcctgtatttccaaatgacttctcttttgtccaatttgcagaattttaatccttgcccttctggccctataatccatgcatttaaaatttcactgtgagccccacattaatataaaacttatttggatgaaaatatttctgtacttctagtactttcagattacattgcatttcctcttcttttaaaatgagtctttcttggaaaagcaaacttttatatcacaatgtattgtatttgcattttatttccattttaattttggttcaataaatatattttagtacccacttaagtttaaatgattagtttttgttatcccattaatttgagtaatgcatttatttttttaaaagcttttaaatattaaagcaggaaaatttaatctcattatagttcaaaagcaaataaagtggttacaatatgaatgtagaattaaggaattttatctcactatattatcactgaagtatttgttgtataataattttaaaaaatatgtttaaatgtccccttccaaattatttcagcagttactatatccttatgttgtgtacctcttgattctggtgtgataggatccaagtaccaagtctttgaaaggtcccaattctaacacccatttcacaactctcactgagaaaagggcagctcctaggagagttaaacagtatatcaggtttgactttgactttatagagctctgtaggctgtagggtgtgagtctagaattctatttcagggattaatggaatttgctacatccttcattctacagatcagtagatgctgtgctaagaagaaatatttggaaaaaaagatatttgcataatttcataacatacattctttctttctttctttcttttttaagatggaaatcatcattctcagtaaactatcgcaaggacaaaaaaaccaaacactgcatgttctcactcataggtgggaattgaacaatgagaacacatggacacaggaaggggaacatcaccctctggggactgttgtggggtggggggaggggggagggatagcattaggagatatacctaatgctaaatgacgagttaatgggtgcagcacactagcatggcacatgtatacatgtgtaactaacctgcacattgtgcacatgtaccctaaaacaaagtataataataaaaaaaatccatgtaacgtctacttcacctttagttaataaatgaattcatcacctgcaagaaaaaaaaaaaaaaaagatggagtttccctctgttgcccaggctggagtgcagtggcgcaatctcggctcactgaaaccttcatctcccgggctcaagcgattctcttgcctcagcctcctgagtagctgggactacatgcgcccaccacaatgcctggctaatttttttgtatttttagtagagaccaggtttcaccagttgggcaggctatatattcttacttctttaatctgagtactaactactgattttttaatgtatttggtattgttttccattaaaatattaagcgccatgtaattttctcctgtggtgtgatgagtattctgaataggtatctaataatcatagatttagtaccctacttaagatacctggtcatttatttcatctttagtctttggatttacattgttcaaaacagtgttggaagtctggtaggttaacttcaatacttgaatacacaaactcacagactgttagaatctatggctacaggattgccctccttgcaatgtggaacttttgggagcagcatcccagcaggccttgtatcctctgctaaagcttacaggatacaaatgctttatttttaaaggtagtgtggtccatcgtagggcagctccaaataattagaaagctgaggtctgcattcatttaacctttcgtcatgggtcttatgttaagcagcagttgccccagtaatgctgccttataaacaaaatgacttacaataagcttgaaacaagcctttgttttcacattcaccagccagcagatgacccgtgttcagctgatctatgcaggactcagtcttcctgcagattcgctgggttcatgcactttgcctgccagggcccaggctaaaggggcagcagttgtgagtgtccttttccctgtgtggatgactagagcatgacaggcaagcctcagcacacaggcactgaaggcctctgcctgtgtcagttaactcaaggtctacctgtcaaagcacatggccaatcacatggccaagcaggaaaggagcaggcccggaccctttgtgcacagtgggaccaagaacaaggggatatttgctggacaataattcacaatatccttctccttaaacgtcatcgctgtatgaaagcaggtcattataagcatcttctgtttgcaaataaagtaactgacaatcagaaagattaaataccttgctctctaggttttactaactaggaaaaccaggaagcaaacttggatctaagtgactcaaaagcccctattttttgccaatgacctctctagtccagcatctctatctatcatctatgtatctatatcatctatctattatgtatttataaatgtaggaagtactttcctaaaggtttatcttttccagctgtaccgtttttgagttactgtcagcattctttttctgttgttgttcatgtaaatctgactcctggctacttttgtcaaaattatttcatactcttaagcatataaaagtccgttactataactggataaaatattgtaaataactttgtagacataatagttcaatatacattctctctaatttaggctacaatgagaccgtgaataaaatcttgaaaactctgggagatacgtgtatggtggtgggatatatacacataccaaggatttcaatcctccctaaattttacctgggcttttgaacattttaaatatttgaaaggcactggttttaacatggcttgcagtagcttttatattatagaatcaaaaaggaagtgatttcagaatattcttttctttactccagaaataaaaagctgatttttttttctgttctttggaaaagcagggaagtgtattaatattgaattaagtctcacaatatttttttgtagtcaaagtgggccgtctgatgtaatctgaatctggttaattttatgaaaatcaaccattacacgatattcttgttccttttacctagacaaaatctaaatcatgaaaagatgaatgttgtatctccatgaaataattaataggacatgtaacttctagttggattcaaattccacttcaattacattgcatgttctttcttcttaaaattaatgtccccaaatattcatattttcaatgattatattagcatattcaacatatacgtttaacacattcacaacaaatttagcaattcgtaatagctacgagaggtataaacaagagtaaaaagagcaattttggccaagtgtggtggctcatgcctgtaatcccagcactttgggaggctgaggtgggcagatcacttgaggccaagagtttgagaccagcctggcccacatggtgaaaccctgtctctactaaaaatacaaaaaattagacaggcatggcggcacatgcttgtaatcccagctacttgggaggctaaggcaggagaattctcaaacctgggaggcagaggttgcagtgagtcaagatcccaccattgcactccagtctggatgataagagcaaaactccgtctcaaaaaaaaagagtaatttctgtcctcaatccgtttacaactttttcccagtgataagataaacatgaccaatgtttaaccattttatgtttcaaggccataaagagctgtcctggtgaatacattctttttgttgtcaccactatctttatgagggtccaaagcaaccagagggcttttaccccatttccactgatacacacgtacacagtataaatggcatcttccaggaaggatacttcttcttaaacttaaatgtattctaatatcacaaagatgttgtctatgtagatgaacatatttgtgtttcccaacaaggagtgacaattggtaacaagttgtacattgctagaagactttttaatctccttgagagttgcctgaggagtgactttgtgtaattgtaatgaccagtttctaacttttctggagatcaaatcacaggagcttaacattttataggaaaatgctcaaagatacttaaacatcatccaaaaaatatgttttgactctattaaggctctgtgttgatattaaaagttgatatcaggcctggcgcggtggctcatgcctataatctcatcactttgggaggccgaggttggcagatcacatgaggtaaggagttcgagaacagcctggccaacatggtgaaaccccctctctactaaaaatacaaaaattagctggttatggtgtcaggagcctataatcccagttactcaggaaactgaggcaggagacttgcttgagcctgggaagcagaggttgcagtgagctgagatcttgccactgcactcaagcctgggtgacagagcatgactctgtctcaaacaaacaaatgaaaaaaataagaaaaaacacagaacctcttaattattctctcccttttaatctcataaaacctctgtaaattaaactccacagagactgatattttaattattttaaaaatctaacattaactcaattcatgttctaagctgggcctccaaaaactgttttatgtatatcatcttattattcattaattatcatgggttattttactgtggtgaggaagttgaaccttaaaattgtttcgattttctctaccagacatgaagattgtagatctattgttgtgaggaacacaatgtcttccccaaatctgctgatttttctctcatgacccttgtttggtgcattttttactatgtaatttaagatatttcttcaatttgaatgttgtagtcactgaacaattactatcctcttcttaaatcatctactgaatagtttagtttgaaaattatgttcctggacttttgaatgttgtactcgaatcttcttaagtactcttgttattttctttggtgcaaaatatcctctgtctcctctagaggctgtattttggtacagtgttcttggctcattcatgattgatgcctaaagctcagtttcggcaaaattagtgagaaggatgcagtgtctctgctcctcgggctggaaggctgtcagtcttttgctgaggcactggaaagaagcggttctcccctgagctgccttacctacaaattcctaagagcccccgggctcacggcatggagaggcccagtccaccttttggtctttcctgctacttcttccctgatctttgccacccttctctttaagtgctgcagagcttctgagatcacgccttccacaggagaggtgcaccgatcctcacccactggatttcaattctggacccaaagctccctcaggttaagtaggaaagttctttccttgttctcacactacacacctttagtgtttgaagtcatattcgttctgtccaggcctgatggttctaaaagttgctcttcttaggaaaggcactggtcattggtttgtggttggtgaagagaccagtggggatgttgtctaacaaatacttaccaatgaatcatttgaaatggcaccacacatttacatgaacacaagaatcgatgtcatcatgtgaaaaatggtgctagcaaactattctattttattttaaaaaaataatttacagcttaattgaaaatcaagatgaatactgaatccttaggtgttggactacatgtatctcagtccttatgttttatctataattcactgatcttcttgagaccactctcttttttttcttatagacatgaagctcacttcctggtattatagttgctattttgaattgcataaatccatgtgaaattatttggagtgaactttattaattcctggccttcatgtagctcattgtaagaaacagcattacttcatagatggactcagtaatgtctacgatttttatatttttccgttaaatatggaatatttagatctttcttgtgataaaagagacatctaaattccatgtgctcataggtaggttgtttgcctaagattgccatacttccagaagcacaagggaatacctgttaacccacgtttggcttcattgagctatccttctctagttatgtttttgtggtcaattgttagtggttgaaattcttaagtatatttcagttactattaaagtattccttggccaggcgcagtggcccaggcctacgatcccagcactttgggaggattgcttgagcctgggagttcgagaccagcctgggcaacatggtgaaacctcatctctaataaagatacaaaaattagccaggtgtagtggtgcacacctataatcccagctacttgggatgctgaagcaggagaattgtttgaacctgtgaggcagaggtttcagtgagctgagatcatgccaccacactccagtctgagatacagagtgagatgctgcctcaaaaatcaatcaataaaaaaaaataattatttaaaaacgcattccttaaaggaaagttcaaaggacaacttatgtcattatatctttacagactcttctctgagtaaattttaaatgttgcttgcttaatttctattaaaatgaatgttaaacatgttatcatctcaaagtcccatggcacatgataaatgcaatgaaattgtattaatataatttatttcccagttaattacaattggaatgattttgaaaaactgctcaacattttatatgctattcctctagtagttcttatttgtactaatatttatgctatttttaaaatttttaaatggaattggaaatccaggggagatttttttgccaattaagtaaaatacaccttattaatatgccagtattttgtcatactaatgtaactaattttcataccattatactatactaattactgtgctaattcatctttttattaggctatggcaaatacttaaagttgaaggcagagatatttcatctgtgaaaagggaaataatcagtggactaagaaataaaagtaatatgttgtgtattttgcttaagaaaaagggtatgtttgatcatgtataaaacgtctaggcagctggctttgatttggcatgcaaaaaggctgtggactcctaccttcacatctgctaaatgtggctataccaaatgctccccagctctcctctacttctcacagctctgagacatgtgaagttctcctgaaattccagaaaatattgtcactattgtgatgctgtgcaattctttacttgcaaagagctcactttattttttaaaaataatttttaaatgttataaatctgctgtccgaacaatacctaaaacgtcttttgttcattggttattcataaaacccttacaatcttagggttggcagagaattttgaattaatctattctaacacttgcatttggggggatagtaaaattgagactaagaaagattatatctttactctgactttatgcagatagtggtcaaagtaaagctagaaattaggtttgctgacatctaattcatcatactcttatgctacggaaaatacttaaaggtgaagacagcaatattttatctgtgaaaagggaaataatcagtggactgaaaaataaaagtaaaaataatcagtgttattaagacaatgcctagtggcatttggttacaatatctaaataaatcctcacaaatcttgagagacaaatgaaattagtccattttactgctgaaaccactgagacacagagaatgtagacactgagacgctggccccatcagataaccaggaaatggcagtgctgttaatgggaaacctgattccttagaagtatcgcaagaacaaaaaaccaaacaccgcatattctcactcataggtgggaattgaacaatgagatcacatggacacatgaaggggaatatcacactctggggactgtggtggggtggggggagcggggagggatagcattgggagatatacctaaggctagatgacgagttagtgggtgcagcgcaccagcatggcacatgtatacatatgtaactaacctgcacaatgtgcacatgtaccctaaaacttaaagtataataataaaaaaaaagcttaacaaccttaaaagaattaaaaattatatgatgtatagtctctgaccatcaaggacttaaactagaaatcgacaacagaaggaaatctggaaaattcacaaaaaaaaaaaaaaaaaaaaaaaaaaaaaaagaagtatccattgaactccttgaggcaatttctgagtgaagggagtagtaagggtaggtactgggaaatatatcacccagaactactcttttgtttgttgttatgagcatagttggaactggattgatctcaagaagattttggagcctggggaaagctttctgcaagaaatgttattttagatctaaatgtttttatcatcaacagactgttcttatagtgcttttattgtttactgcttttactgtttgtcttcattcacataacttccatgtgctatatactgtatcatgccatgaaaaataaaacaataaagcaagcccctgtcctcagagagcatctgaggaaagacagtagacagattatgagaagtgttgtaaagacttttttgtgctgttgtgttaaacaacgcaaaatcctgatgagaatatggggagagaagacctccctctaagggtgagaaccgaagagaggcataaaccatggtgagaggcataaaaccatggtgagaggcattccacagaagagaaacaactcacaaacgagcatggaaatgggaaagatcttggcctgtctgacaaattagaggctgctgtggctggagctcaggaatgaagaagatgctagcatagaataggttagagaaataggcagtaggctgagggtttaaggaggtacgtggtaatccacccattattgctactgttattgttgttcttatcaacagccaccaaaaagtatctgacttgggatgaggcagtgataggattgtgcagaggctgatgccacaccagtggactaggccacacatgacagtaatgtagatgtacagatagatgctggcagatttggaatgtgttaccagagttaaatatataggactttttaatagctttgacttaataggtaatcataagaagaaaccaaggtggaccttctagatgtttgacttggctaactagttgagtaggatacaaattactgaaatggaaataacttgagatagaacaagtattgactggtggcataggcagaaatcaattgttcagtatcatgtacgttcatgtagataaatttgttgccttccatgcagagatgcaaatcaataggtagatacatgagtatagggctctgaggagtctgaaattgacatataaatttagaaattattagcttataggtgagatttatatttataagaattaatgagatcatcaagagtgacaagaagattaaagtccaggaatgactttgaagaactccaacatttagaagaacaaagtaaggagaaaccagcagaatagactgtgacagacagggctctaacaggaaacaatgaagtcaaagcccctcctcctcttgtccatagatagagtagaccaactcacagaacttcagtcttctctccagggatccagccagtctgagaggacccttggggggaaacagaggataaatttcctgtcctcattgtcctctgtccttccttggttctctgttgatgctgcccattggccatatttccctgggaactagagattacaagtgcccttaccatacaggtcagggtcccaggtgctaaagagggtagacaagctggggagtcatctgaagatgcccacagaaggtgcctggcacagagagtaaaatattttaatttaagattatgaagattatatgctcttttcttaattttgatgatatgtaaatgcaaaggaaatgtagaagatatctatttgttatctcatcagggtatgttcagaattaagttacctgagacactggaaatttgctggaaaagttcataaccctattcaggcattggtattgttattgctgatgtcgggtcgcccattgagtaaaggaagacacatcctgtcagaaaaataaaaccagttttgtgcagattccgtttgcttattggaaaatcctgtctgtgaaaaaggtactatttcagctctgcagaggcaacttgaaattattttatgtagtaattgcataactacaacttgctgctttttccttcatgcacttctattatattcatagcaaaaatgttctagattgaaaaccaaaagatggaaattcctttatttctttagtgaaaaaagttaaggattgagatcatttaataatattttctgttacaatcaaattgtagaagacaagattagcaccgttatgagaatgatttgtataaaaagatttgtagtcacttagcatctattttaattccatctttatctttctgataattgtaaactaactgggtaatttttaaaggaaatactaccagagagagaatcacatatggttagaaagtaaaacttaaatgaatgttattgtcttaaagtgtagtaattaaattagtaggccacattcagagagatgtcaagtagctaaatggttcaagcacttgattagtaactatgtatcaaacataaaagtcaccaacagctctcctttataaaaattatgttaggctgtaagatctaataagtactgcaagtgaaagtgaatttgtaaatgctgctatttagaggagaaaggtgatttgtttataagtcttattctgtggcaatttttcaccaagaaatacgtactcaaaagcaatacttgaaagaaccagaaactgtattttctctgcagtttctttcagtctttaattttttattctaatacaatttgtatttctaaattgtcatgctaaattgaaattttacatgacagaagcccttagttaaatcttcccctctcataaaatactgagccagagactgatgacaaagcttattttcattattataagtccagagtttttcttttccaatgttaatgtttcctatttcttttttaaagcatatcgacttacttattgttctgcaatattactgtaagtaatatgtcttattgtattactccaaagaagaaactttgtattctagaaatattgtagaaaactacaacaatttttaattatttgagatcaatatatgctaaatgtttattttccagtattccagtaagcagaatgtttaactggcatctatttaattggtctgttatcaatgactcaaaaaatgtgatcaaatctgaagtgtttccatgaacatccaaagaaagattatgcttggcacaattttaatattaggtatctttagtgttatgtttataaaaggttcataatttatacatgttataagtgagaacactcttagtcagaatatttggcacacttcatttcctttcaagaccaaagaccaaagactttgtgtaatctatttcaatatacattcagttatctcctaaatctgttgtgtgtactgactggacaattcactctttgttttttgctagctaaaataattttaaacctaaaatgatctcattagattgcattcatgcggtaaagtgatgttgtcttccaatagagttccagtccctgctggctcgatggcaggctgtcttcataaggagctcagcacgcacattgccctggcacctcaggtgaggcagagccttgcactatggcagggtccagtgaatgcttcaagcctctttagcccattcacatgcacaggcaagaggtaaagctcttacagttacaaatccactgggagtaccttttcatcacttacttgtctttaatgggaaatgaattaacatgattggctcttaccaggaacttagtagtattcttttgattttaattgacttgctgcttacaaatgttgttaactcaccagaaagggaggagttcccaatattcgcattggcagtactctcctcagtaaaagacaaaggctaaatctttgtccaacattactagagatgctgccaaaccactgtggtggcccacgctgcaaaactgcattgtcacacatgaaaagggctctgtattccctcgctgtgtcatcatggagattaatatcatttataagcttttctcaggcttgtcgatttatgggcagtaagctctgagaagcccttgacattgacttctgagcccttggcaaaataattctaggacccaagtatgtcatctcattttctatgccatgtttcttctgctttcttttcattgccatatattgttttctctgccagaatacgtttctctccagctagacagatttgctgatcaaagaagtctcctgaagtgttacatacatcaattgctatttatttaacaggtttcaccgatactaagatcatagggatttaaaattctgatctgggttactttcattttgcagaaagatgtttaacttatttttgcaaatatagtaattttaggttctgcaaagacataatttaagcatttgagcaaaacacattgtacaacttgtttgagaaccttacaaagccaatatagtacaactgaggcaaaacctaaaacaaacaacccaaacagtgtcctttgactgaagtatccaaattgacaaaatctaatcttttcagataactggcaatcttcaactttattttgctattttatacagtggttctagcatatctcctcagtgtgtgttaaaactaatgtgggtggtaagtaagtttggttcagctgtgaaattggatgggtcatgtacagccaggcagttcatagcgtagggtagctctgaccagacacaggtttgtctccagatccacatttaaaaattgtacttttgttgattagtgtttcccaatttcatttattttactgagggttgcaaaatagcagttttctacctggattatattctctgcatgtatttgttttcatttctctttttttttaattttattttgctaaacagctatatgaaaggatcagacagacatatcctggacccactgatcatccttcatataaataaaagtaggaaaacaaagaaaaaaaatgggactttaagaaccatggtaaataatatattaacttagataagcatgggtaattcagtctctctcttttttaaagattttctttcccctcctccagctttatttcagccagatatagaaagacaaatactgcatgttattgtttatatgtggaatgtaagaactcatagaaacagagagcagaaaggtgttttgccaggggataggagggtgagggaaatggagggactttggttaaagggtatgaaattttagttacaagatgagtaagttaattcagtcttttaagacagcatgctaaaaagctctaacaaaagtagcatagtcagtaacctaacccagttctagaagcacatcattaagatggtgcttctgcacccctaactggtgttcatgtggggatcctgaagaactgtatgggtcttgtctcattctcacagtttccagcagacagccatgttttgtaaaaaagattgggaagagcaacatcagcaaaatgccattcccctgagctaattttagctatgacagtcctacatagagtatatttcttctcattccaatgaaatgaattcattttctaaatgtattattaactacagttgttgtttatctttatgttcctttacttcattattgctgtactttgtgtgaagtagtttaagcacttgaagttggtctagcctcatgtaggggggtaagtgtgtcatgattagtgtgtctccacacaccagatgagtgacaagcaggcagaatgtttgggaaggatagtccagcaggaaagaaacatgttccagaatgcagagaaccctcgattacttgattttacagttatgcagataaatgtaaaaactggaatgtcattcagtctgagccaggttacttactcagatgcttaccttcccctttgccctttggttgggttttggagagttgaccgaaaggggtgatggctttaaaactacacagatgaagcagactgcacaacatggggagaccctatctccacacaaattttttttttaaaagccaggcatggtggtgtgtgcctgtagtcccagctactcaggaggctgagactagaggatggtttgaaccgggagttgaagtccagcctgggcaacagagtgagattgcatcttaaaaaataaacaaataaataaacattattcaaatgacataggacttgtggatcatgagattagagtctagctcttaaaaaaaaaattctgctgtccaagtttaatgcttgaacttccacagttaaagatttaactcttcagtgttggtaagaggttggggattcaaataaatgtggagaccacgaaatgaaggtaggtgagagagaagccatttactagggctccaaggaagatgcagaggcccacaaaaggacaaaggcccagcctatggggatcacagatcagcactttaggttcactgtagggctgaacacaaggcacacatccagcagggaggcacatacctgcggacagaatggtggaaaaatgatgtccattttgacaaaatagggagtgaaaggacatccattatggagagatgaacagctaacagggggcagtgtcctacaattccaggagtgagtggcttgtcaacattttctttgttttctttctttttttttttttggagacagtctcgctctgtagcccaggccggaacccagtggtgtgatctcggctcactgcaacctccacctccagggttcaagcagttctctgcctcagcctcccaagtagctgggactacaggcgcctgccaccacgcctggctaattttggtaattttagtagagacaaggtttcaccatgttggccaggctggtcttgaactgctgacctcgtgatccacccgccttggcctcccaaagtgctgggattacaggcgtgagccactacgcccagccaacattttccttctaatccaagaatttactactatgaaatgtagttaggatcactcttaggcaaaaacagtatagcacataattacagataaatcattactggtcatagagtagaaagataattcttattatcagagaaatttctccatttgggtccccaaagcaaagattatggccttcataacagtgtaaatgtagcttcaaacaaagcctaaagtatcttgtgtttgaaagtgtgcttttaagcataaaattacatgctttttgatctgttagttaatgtgcaaaatatgattctccttgcaatatacacgttaaattcatctaattagctcttttgaatttttttgtttgcttcattatttctcaactactcaaaataagtagctgatatgaaattctcgatattttcattagtaattgttaaatcatattgcaagcattttctgatttatggaaattaggctcagaggaaaatgtacgggtgccaagggctttctcctccctccttgctgtccctgggaaagagcatgctggtgaaaagcaagaaggcaggacaaaagggggagacaagtcttttctgttattcttgattaaatgtcattgataaataggactccactgacttggagccctcagtttatgggattccaaatgctctggcatcacactcattggcccttgacttgttttccacagaggtgttgttagcacgctagcagtcactccccactgccccatctcagctctacacagacactaatctgctttctgtctgtatagatttgcctattttggacatttcatataaatggaatcatacaatatatgtgttttttgcaactgacatttttacttgggacaatgttttcaaggtccatccatgttgtgtagcacgtgtcaatacttcatttaattttatggctaaataacattccattatatggaaatgccacattttgttcatccgtttagcagttgatgaatatttcacctgtttctacttttgggctattatgaataatgcttttgtgaacagctgtatccaagtttttgtgtagagaagtatgctataatttacagttagtttttagaatacaaatggtaacctttccctatctgcatggcacacttgcttatccatgaatgttactgaagtccatttgaatcctttaaggtaaaatggatgaggatttctagtttaacccttatgcttttgagatttaaaaaactggatcccatgaaattaataaattacccaaggtgttacagctaattagcgtcaacagtataactcaaaatttgcttgagattcagttcagcattcttttaccgtgcattgtaaacccacacagggtgcaactgaactaagctgagatcatatgagctgacctgagaagcttccttttgtaactgtttttctttggagaatagatttggtttccaaacagacctatatctaattaccatatttgatgcttcataagaatgtgtgtgtatgcagtgatttgttttcttgactctcaatttgtatcgatttaatgtaacaacaaatatctattgagcataaataatgctgttaacattgaatattttggaatgcaaaggcaattacaactgtattaataaatcaagagtcaagataatacaacagttaataataaagtaggtaatgaagggttaaattgtatgtttttgggccacttacagcataatatacagaattgattgctaaaagatggattttgatcccacctttagtaataattagaaatctgattttgaaaaaagaaatctatttctttgagtgaaagttacattacctttgaaaggacgatatgttgatatctagggtgccttatagccataagatgctacagttcaaatggcaccatgtgttagagtaatacacacatatatgcagagacatataatgggcagatgctcacatatatcacatgtaagtgagtcagaaaacaaggtcatcatgaggaaagagctctaaaaagatctgggtcttgttccaactctgtggtgccactcaaagcccatgtgactctctgagtctgtatttacctcagatagagacaatagatgcatcctgccctcctcctcctctctttgggatgcaatgagataatggcccctctattcttgggtagagtattgaatatcttacgtggattaaggaaatgtggaggactccctagggccctacacaggaagagcattatcaggagcggaaagttacctgtataggaaaatgtgcttttattgaaatactatcttgaaaactttctatttgataggactgtcatcttccagaatcctagatgctggcttgggcaagaataaaacatatggacagttgtcagtggatctacaggtttagctaagcttggttatgcagggtcaccctgttctctgtggagtctacttcataaacatagctggactatttttatcccccctcagagctgtttccactttaaaataaatttctattcattgttgtttgccaggcaaaaatcatatgcagcaatgctactaacattgatattttatttaaacatgttgataagaatgtggcacctaataagaaatccatatcccaccatcagccataggcccagaatccactgtggatgagaaacttttgattataggaaaaagaataattggtgctttctaacctgtagaaacttggatgcctgttggagccacttgctattccttaaacataatcattcttgcatcctgacccacattcttcctgaaacaaaattttcaatattgtcttttttgttgctgttgaaggtctgtgtttgcaatgattaccttgctaaataaaaacttctgagtatttctacatcactgctaagaataatattttagtggaattccttagaataagactttctactatacattattgcacgagaatatgcctgatatacttaaaagagaacaatggtagctaacattgattgaaagcatctgcggaggcagctatttgttgaaatgccctctctacatcagatcacatggctcacatttacctcgtaaatttggaactcctgtcacccttttctaatggagaaggacacagacttgggagaattcaatgacttgttgaaaccacacaattaagtactatcaagtcacctcttgagtgtccatccaagtatagaaaaaatagcgtcttttctactggctttacaaaagggatttgtaattgactttcagggagtttgagaatggcaagaaaagccatgtcaatggcagccggacaaacattctccagcttcccctctgctcccagggcctccctggggctcagattagtaggttgcccttgagcggacattgagaaacaaatgcaaagccctgtggaaggcagctaaggtcagaggtggagaggaagaggtgtagggtggggagagcacaggtgactgtctgaccataagatgagcttcataatcagatgaggcggctagttggaatgtgaggtcagcaaggatgagaagcagatgagactagccctggggcatgcaggaagctgagagacttgagagagtggttcttttttggggggcgggtgatatctagggtgccttatagccataagatgctgcagttcaaatggcacaatgtgttattttgagtaacacacacatacatgcagacacatgtaatgggcagatgctcacatatatcacatataaatgagtcaggaaacaaggtcatcatgaggaaagagctctaaaaagagccgggtcttgttccaactctgtgctgccactcaaggcccatgtgagtctctgagtctgtatttacctcagatagagacagtagatgcatcctgcccttcttctcctctcgttgggatgcaatgagataatggccttgctctgtcacccaggctggggtgcagtgatgtgacctcaactcactgcaacctcttcctcccagttcaagagatgcttctgcctcagcctcctgagtagctgggattacaggtgcatgccccacgcccagctaattttgtatttttagtagaaatggaatttcaccatgctggccaggctggtcttgaactcttgacctcaagttgttccacctgccttggcatcccaagttctgggattataggcatgagccactgcgcccaacaaagagtggttctaaccacagattcccgggctgtttgtagcagggaggcaggcagtatctggcaggagcaggggtacagccagggatccacgactcctgagtaggtgcttctcaagccagaggcgggaagcgcaatccaagaagtgaccgtctccttgcagtttcatgacagcacctcctgtagttgtagcagatgaaagctaaacagattagttaaaggaatacatgagtggatgcatgaataaagtataagggaatgaatccaaccctaagttagaaaaccctcttcatccttaatcataccacctccatagttttcccttcctcaggaagcaaagcgccaagacatctacccacagcatgtgctgtatgaacggtttgctgcaaacactctgccaggattcaaataaacaggagatcagaaactagtgttggaaaatgtcttttggcacattgcccaactgtgatcttggcacggctgattttgttttggtttatgtcttgggctttcaatgttcattttcatactgctgtttcacaattttattttcttttttgagtcatagtttgtaagaacttggtttatattactattccaatgcaatagtgtttttcttttggtatgtagtatgctctccaataaattagaagtcactagtcttgcctctttaccatgcagaaaactttcctgatcaagcaagcattgcccctatatcttgctcctctccattctgtcagctgggtggaattcagtccagtgctaacaggttgaggtttcctttactacaagctactggtctttgcactgtaccttctgatgattgtttaatctcaaatgcatgtagcaatgctatgaatagctcccactttatttcagtgagttttaaaacttcatgaaaatagaacttcacagagacttcattttcttctctgttttccatagccaatatgataaaacgtgtttgtaaatcttttcaatttagaaagactttttcttcagcttctcatcaatgtctgatatttaagaacttatacataaagctcaaaatgagaaaaatagcttgcatcaaatccattaaattcccagaagttattttcaactccacccaagttaaattaaataacatgtatgcctcacaaaagtcacagcaccttgtttatagtaggcactcagtgtgattgatgtgtcaacttgtctaggccacagtacctagatatttggttaaacattattctagatgttcctgtaaaggtattttttagatgaggttaatatttgaatcagtagacttggagcaaagtagattactcttcaagtggatgaccacatctaatcagttgaagaccttggaaggataagactggctccccacaaggaggagggagtcttgccacatactgccttcaggcttgagctgcagtgtcatctctgccctgggtctgcaactagcagctgaccctgcagattttagacttgtcattctccacagttgcatgatcacatgagccaataccttcaaatcaatcccaatgtttctctagttctctctctctctacatagatagctaggtagattgatagacaggtagatgataactaggcagataggtagagattatatacataggtgaataataggtaaacaggcacaggcatatactctatctgttctgtttctttagaggactctggcaaatacttactgacagttggattagtccttctttcttcccatgtgggaaacctctggaacaggtgcgttctactcactttcaccttgtttaggcatatttgttgaaacaaagtttccccttttctcatttctacatttttattctattttccatttttagccaacattttgatatttatccagttccatgatagtaggtattcattagtgatctcttccaaaaattgtctttgttacctccaagatagatggaattattctcagtataattttgaagtttagtgtatttcattttttctataattgatagccatgtatggcacattaagtattatcaaaccacattagaaatagaatttaatataaattagagtttatttatacagtagttattaaggcaagttaaaattaatggcataccgaacaggatagagcatgggatctctgacctttattttcagttaaaatagaaaacattgaaatgataccactgtttcatgaaatgtctagtatgacgctctggcactgaccacactcgtctattaaattggcatgatttagctatcactgatatttgccattaattctgcttatacctatgagggtgataaaagtcaactgtgacaatctacacatcaatttagcagtaaggatacagttctcctgtggattctaacaaatctagtacagaaggaggcactcagtaggtgatgacgatgatgttaatggaatgtaatactcctttttatatgagtttctttatgaacttctggatatgtatacagtgactgaggcctggatatatttgctaatgcaacaactcactgtctaatcagtctgttctcctctcaaggacatttcactttgattctcatgcttactcaccttaacaaacagaaaatgaattcagaaatgaataattgggcttatgagtggaagctcaagagaatcctgctctggacaccaggacaatagtctctagggaaatgtgaaatctccataagcagacactgggttgcttttagctgcttaatgtggttgttgtcatgcgccttgattgctccaacctctctagccccatcagaaatgttccatttttagataaccgaatgtttttcatgaaaataacacaaatagggcccactctggcttttgcaatttcaaagatatttaaaaccaaatggcatattacaaattttagttatcatcctcctcttttatctattttttcccaaatgtcatttctactaattcagtgtttttctaacttcctcctgtgatctttcatctcctttcattttaccttttctttcagtctatatggaaattaaagggagtccatttttgagttcctgctgtttcagtgttttatgctggactttcttatgcctccccttcatctacccaactaagctctgtgcatcttccttgttatgactttttgctgcaagtatactcagcatgtaatgttcatctctagaatatatctggtttctatttctgattcaatttctacttgctcaagtctctcttggactatttttcttgtctctattgggaaaatctgagaaaaaaatagagtttggagcctgtctaattaggtttgaagctttggtaaagttgcttctttcaagcctcagtttctgtctttgtaaaaaggtatatttatagttattagtccataaaatcattgtaaatttgttgatttgtacgggaaatacagtcagtactttaagtgtttagttaccatttttgtttttcctgtttaaaaaaagtctatagcttattccagtctttttttaaattaattaattaatttttttttttttgacagagtctcggtctgttcctcaggcttgagtgcagtggtgcaatctctgctcactgcaacctcagcctcccaacttcaagctattctcttgccttagcctccctagtagctgggactacaggcacccgctaccacatctggctaatttttgtatttttagtagaggcggggtttcaccatgttggccaggctggtctcaaactcctgacctcaaatgatccatccaccttggcctcccaaagtgctgagattacaggtgtcagccaccacgcccagcctattccagtctttttgactaaaacacatatttaacctatggaaataatttatttttattttacttttattccattggtagtgaatttgtaaccaagaatgggtatgatgacgtgtgaaattatttcctttactatataggcatatttttatgtgctactttgtgtatatctagcatatattaaataataaataattgttcgatggttatattgcaatgcaaatagatgtttatgtaaatttagtgccatatcacaaatttgctagcaagatttttttcaataatctataaacaatgtcaagaaaatatttttgtgctttctttactatttggagagcactctattagaaaaaatgccaggaataataacaatagcttatactcactattggccaggcattgtcccaagggcgtaagtattttatcatcctcataacagtccttcgaagctgggccagttgtgatttttatttcacaaatgaaaaaacagatgtacagtataggttatttcttccccaaagtcacatgtttaatggcaagaaaaaggggcttgaagaatgcctgtctggctttggagtctgtcctcttagcatgcagaaagcctgttctcagggagcttacagtctgttctcaggatggtgttttgtcacatgtgacacagccatttgtttcatcttgttttatctattataaaatctacttctgtagacatgagactgtgaacttttctgtattgtttactttctgctttggtagatacatttgctcattgcacatacgtggtgatgcaagtttttcatctgataaaatcttcacttttcattgatttttgttctcaatttttattaatttattataatatataaactttgttttaattcgaattggttaatttggacaggaaaaaaagttcagtaaatataatttttagccttttctcaacctgccttcaccataagagtgccaggtgtctgagttcaaccctttctctgaaatagctttttcatttgtagtgagaattgataagtgttaattatcactgaaagtgagattaaagcagtgaaaagttccattaagaagaattaattactaggctggcatttaatggaaaggtcttaagcaaataataagatgccatcagcatcttattacatctcgctactgacatttgtagtttaagatcatgattatcaaattaatctggctttacagcagcttcctccctgtccccaggactgtgcacttttctacacagatacaagagcgagggtattctcctcagtcttggtcctatccttcagtgtcttgcagtacttcagagaatcaccctattcatcttccaagtccagttatgcttactctatacctggtgaacagtctttgtttttttttctgcaagtaaatacaatggtcttttcaccatatgtcaatatataccattggaaggaaagattttgggcagagcagaaggaaaaatgtattttgttcttccaatttctttgtgtccaaagccattgcccacatccttcattgaatctgatgatttaaaatgtgcccccaaagtctccagtacttaccaaaacacaatatatttgcttatgaaatttcagcaccttctcttcccccccaattatggtgtattttgtctcatgtaaagatcattaaacttttttgacttttgattcttgtgacttgagaattaccaataaagaacacaagcaaaaatattttacccattaggttggcacaatgtcttgacattgcattaatttttcagttccaaaattttcataagatctaaagtggaaagatccagatcactagatgcaatactgaaaggataagggcaagaacttgtaataaagtttaaagtttccaggtttctacatgcaaaagacatctccttattcagaggaaataatatcaatttgggaggatcagatgtagcttcaggatgcaggttataccaaagagatagacccttattcttccagatagaccaaagctatagctggaagaataatgaagacttctccatgaaagagaggacctcccaggcaagcaagaagccatttatctcctgcaatccaatcataattatttacaggcgctgtgttccagagttccagaaaaccaaaaggcagacacattccggatagaactggggatgacagatctttcccttggactgatgagcactacaggcaaagggcgatactgaggcagaataatatatttcaggctgcatttaaaactccagagacttgagtgccaagtaaaggagtctggataaagtctggaggaaggggacagagagagaatatttttgagctttggaaatattaactgggaattagtgtgtaaaatgaattggaggcagaatgatagacagattaggtgacagcaaagtaactaatggattggtggcttgtatgtgtgctgcttaactcaaaatcttctgcattgattatttttctttttaataacgtggtgaataattttttaagaggcttggtttactttttaaatttttttcttttaattatttatgagtctttaataattcagagagaggcattaatgcgaggaaaccttggatttgcttcaccacaggatgccataaactactttatgggaagttgtagaatttacaaaaattctcaaaagcaaatacacattttaattcatttaatctttttttttttttttttttttttttttgaaatggactctctctctgtcgcccaggcaggagtgcaatggtgcaatctcggctcactgcaacctctgcctcccatgttcaagcaattctcctgcctcagcctcccaagtaactgggattacaggtgcccaccaccatgcccagctaattttggtatttttagtagagacggggtttcaccatgttggtcaggctggtgtcaacctcctgacctcaggtgatccaccggcctcgttctcccaaagtgctcagattacaggagtgagtcaccatgcctcgccattcacttagtttttcaagttacatccattacatatgatcatgtagggtggggtcaggttaaagaagagagataccctcactgtcaaaacaacaatgacatcatggtgtatgttccaagttacagaatttgaaaagttgctatttcttcttcactcttcctcagccacactcaaaatgctgttatagattcatgctgctttttgatggtggaataaaaaacctgtgtgtgtgtgtgtgtgtgtgtgtgtgttttcaggctggtgtgctattgaatccttataaaacaagactgtctcatgtttttatttcttattttactcaaattgccaatacaaatacttattaaggaaacagttagaccaatctcagggtgacttgagaataggattggcgtaaagaatgcaacttttactctggttggcctcttactgctaaagggtttcagtgatttgacaactccagtaatatctctgtatctcaccatctggcaaaatttcacagtgcctatttgatgagtaagaggtgctacgagatcatcacgaggaaatttcagcaccaacaaacagcttcaagaattgtttatgcccactgggtagtgctgcaaacagacacatacactgaaatatgttgctttgttttagaaacacatgtacttcctgttgtagtttttaattttttcagtaatgcatgtgtgtttagccgcactctttttaattcattcaacatctagcatttagtgaccctgtctgatgtgaacagtgcttctcttccagggactaatgcagttgttttagattattgtttcttccctgcagcttccaaaataattaatagcaaatcactcatttcatttaagaaataggtatttcctcccttggaatccaaattatatttagatgtttttatttgtcctctattccataagatcactgaccacgtagagggtcagagaaggttataacttacgtagctctaattcgcatgtctctagagaagaacattctgtcgtcctaaattctgcagctagtgagactggcaaaccacttatttttaatgctagagactcctttctcccaccttgaagagttggcagctctggttagggaatgatgccagatctaagcaaagctgacttaaagtatgggtaatctgggacaccagtggtgctatgaatgcacacaggactcaactcccagctgggttcagatgaaaagagtctggctgatgaattctaccacaggtacaaggaggagctggtaccattcattctgaaactattccaatcaatagaaaaagagggaatcctccctaactcattttatgaggccagcatcatcctgataccaaagcctggcagagacacaaccaaaaaagagaattttagaccaatatccctgatgaacatcgatgcaaaaatcctcaataaaatactggcaaactgaatccagcagcacatcaaaaagcttattcaccatgatcaagagggcttcatccctggtttgcaaggctggttcaacatatgccaatcaataaacaatccagcatataaacagaaccaagacaaaaaccacatgattatctcagtagatgcagaaaaggcctttgaaaaatttcaacaacccttcatgctgaaaactctcaataaattaggtattgacgggacgtatctcaaaataataagagctatctatgacaaacccacagccaatatcatactgaatgggcaaaaactgggagcactccctttcaaaactggcacaagacagatgccctccctcaccactcctattcaacatagtgttggaagttctggccagggcaaataggcagaagaaggaaataaagggtattcaattaggaaaagaggaagtcaaattgtccctgtttgcggatgaaatgattgtatatctggaaaaccccattgtctcagtccaaaatctccttaagctgacaggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccagcttacaagggaagtgaaggacctcttcaaggagaactacaaaccactgctcaaggaaataaaagaggatacaaagaaatggaagaacattccatgctcatgggtaggaagaatcaatatcatgaaaatggccattctgcccagggtaatttatagattcaatgccatccccatcaagctaccaatgactttcttcacagaattggaaaaaactactttcaagttcatgtggaaccaaaaaggagcctgcattgctaagtcaatcctaagccaaaagaacaaagctggaggcatcatgctacctgacttcaaactatactacaaggccacagtaaccaaaacagcatggtactggtaccaaaacagaggtattgaccaatgtaacagaacagagccctcagaaataatgccgcatatctacaaccacctgatctttgacaaacctgacaaaaacaagaaatgaggaaaggattctctatttaataaatggtgctgggaaaactggctagccatatgtagaaagctgaaactggatcccttccttacatcttatacaaaaattaattcaagatggattaaagacttcaatgttagacctaaaaccataaaaaccctagaagaaaacctaggcaataccattcaggatataggcatgggcgaggacttcatgtctaaaacatcaaaagcaatggcaacaaaagccaaaattgacaaatgggatctaattaaactaaagagcttctgcacagcaaaagaaactaccatcagagtgaacaggcaacctacagagtggaagaaaatttttgcaacctactcatctgacaaagggctaatatccagaatctacaatgaactctaacaaatttacaagaaaaaaaaacaaccccatcaacaagtgggtgaagggtatgaacagacacttctcaaaagaagacatctatgcagccaaaatacagtgaaaaaatgctcatcatcactggccatcagagaaacgcaaatcagaaccacaatgagatatcatctcagaccagttagaatggtgatcattaaaaagtcaggaaacaacaggtgctggagaggatgtggagaaatagggacgcttttacactgttggtgggactgtaaactaattcaaccattgtggaagttggtgtggcgattcctcagggatctagaactagaaatgccatttgacccagccatcccattactgggtatatacccaaaggattataaatcatactgctataaagacacaagcacacgtatgtttattgcggcactattcacaatagcaaagacttggaaccaagccaaatgtccaacaatgatagactggattaagaaaatgtggcacatatacaccatggaatactatgcagccataaaaaagatgagttcatgtcctttgtagggacatggatgaagctggaaaccgtcattctcagcaaactatcacaaggacaaaaaaccaaacaccgcatgttctcactcataggtgggaattgaacaatgagaacacatggagacaggaaggggaacatcacacaccagggcctgttgtggggtggggggaagggggaggggtagcattagaagatatacctaatgttaaatgacgagttaatgggtgcagcacaccaacatggcacatgtatacatatgtaactaacctgcacgttgtgcacatgtaccctaaaagttaaagcataataataaaaaaaaaaaaagaaaagagtctggctgaggtccagatgagatgaaatttactgcttcactttggtgagtcttggctttcattaatatgcatcagtgtatcttatagaattagaaatatttgaagcaaggaataaaaatgaaaacacagtatatactgaagaaaagagtattcctgttcatttggcatagatcaaatcagttgaacttaaaactgtagaataaaattacagatacagaggtcaagaaaggaatatttggagaaaataaaaatgaaaacaacaatgataaatttggataccatttgataacatatagaatttcatttcaacaaaacatacttctacaatgctatagtaacgacattaagttctgtgttttcattcaaattaagtaatagaagattcttgatgctaagaattctaccttcttagtggaaatcatataaatattttaccataagccccaattttttatgtcgttagaatgttaggctgtttcctctttgaattcattaagagtattcatcatttcaagttttcacttttttatactaggaagtatgctgttttccaaagagaatgaatgtaagttacaaaatttcaaatcatccagcttccttattttcctatctggaagcacatgccacaactccattagcaaaacatagtaacgatagcccgataaaattaattcccaaaaattaccttagagttttaatcttttccaaatggaggccaataaaataccacagccacaataatattccattgatgagcgccaataccttcctagccctccatgttgtagcgggtgccttcatatattttatttgcttctttggacttctcaaatattccatgagataaagagttaaagcatgaataaaacatctgttttccagaaaaggaatctatatgcccaagggcacatagttaacatatgatgaaatcatcttcaggtctttcacttcaagttccttgctctttcaactatttctcaagatgaatgcaaaagggattatttttcttttggtgtcataagagagccctggcctggcctaggaattggaagaacatagtcctcacgtgccagatcagtgatttgtataggctgtgtgactttgtggttccctacatcaactgtaaaatgaaggccctgaactagatcattttaagtacttacagctataaaatccaacgactctatttaaaataatgtaagaagcttaagaaaaattgcatctataataagttttattgctgaaagtttcccagaatgtatcctgcaaactacagtgccacatatgttaatatatatattatggcataaaagaatcttgtgggtaattggttttgggaaatgtagagtaaaacaaaattaggcataatccctttatggcagaacttctctgtgactaacattccaattgcggagtgaaactagagaaagaacatggagagtgcacaggtccaggcagggtccatggacacgtccatggaaatgatagtccaggaaaggttctctgagaaaagctgtcatgtccaaactgtcagtgatggttctcaatgggcgaatcatggctctcttccaaatggacctagaggtggctatgggctgtgtacttaaagacatatttggcggaataaaattaaaagaaatttcttaataaatataactgcaaactaaacttttagactgccttaattcataatcacctcaactgccgagattatttagcaatattcaagagattttttcattcttctttacctatagtagtgctggataaaaggatttctggaatttcttagaatttcatattaagaatacccgattatctttgccttagtatgcttgttgatgttggtgatatgatacaaagctattcaaggaagcttcctaaggttcatgtttcgattaatcgccacaacatgcacagcagcgcttgccttcaagatcattggagctgtgcagggttgtcaaattgacatgcagtctccacaatctgataatttttttttcttattactgttttcaggatgagaatatgaagctgatctgaatgcttttgacatccataggacttgcaagatagctctccaataactataacagacaggttctctatacacataaatcataggtagtccacaagaaggggactcttattttcagtccgaggaaagatttctcctgttttaaaacaatatgactgtgtgcctgcaagactcacaaaacatatatatatatatgtgtgtgtgtgtgtgtgtgtgtaaaggctccattcttgatatataattttaacagtttttgtcttagagataaattaatgggattgagaatttgttaaattgacttttcttcaacattttttcctacttatttgtttattttcatgttggtggtgaattacatgaaattgtctttcatttattttttcagtgaacagctagttttacaaactacatttgctccctgagttagttattcttatttttatttcaaaaactgtgatagagaaagaattggaaagaagacctactgtcattcttggcaactattactaattttgagatgcatgtctcaatttaccccagaagcaatattcatccagaggtaccttgcaatcagtgatacatttaattagatcctatatcttctttgagaaaagcaaggcctgatgtgaaggctcagtgtgtgtatatttgtgtggaaaatggaaagaaataggaaaataagttttttttgtttcataaagtgatatttatatgaaattatattagttaagtgcctcagacacaaacagaaaggattggatggcaagtcatccacttattctctgtgtttttgcatttttgtatttcttctaaaaatgtacatattgcctgatttctgccaggttgtggggctgaataagcagatagttccctagtttcatgaaactttcattggagtgtttgtgtttgggaggataggaggaacaggaaataagaaacagaaatagcctgtggagtgttcctgagtgtttggcacagaatatttaaatgtcatgccaaaagaaaagtgtcttaaatttgtccagggaagcctactctgaggagtgaattttaaactgagatgtaattgacagagcaaaaccaaccataccaggattagaagagttaacagcagagcggaggcgcccaggtaggagtgagcccacaggttagaggaagcaagagaagggagctctgagtcctgatcatgcaggatactgtaaagccaaggagagaaattttgcttaaattctgggtacaatgggaagccaccaccatattttaagcaagactaaatggcatgctttctttgattttgaagagatcattctggctactatgtgcagaaacgaatcatagaggaaagcagctcagagactggaggtgggcttgtctcagtgaccatgggcagaggctgacaatttgcagcaggaagtgcttgtgagaaaaaaatggatatattttagactttgattccatgttttaataatgaggtgtgggaaggcacagtcattgcaactcaattcaaagagaagagcaaccagtctgagagggaaggtgggtgggaagtggagagcttagagaagtgtctgcaagatgaagtaaggatgaatgacaagtcctctcagcaagccaaagcagactcaatagataaaaatgggcatatgactgcaaagcatgtttaacttcttgtgctagacccataaataatttagactgtttttttttcagaaattaaaaaaacaacagacaaagcaattcagaaaatgtagggactgtgctttttttcattcccattttgaacgcagtgctttgtttgaaactaggaaggatatgaaaggttgttttgagagtgctccatcccagagacctgtgcaaggtcacctccatctctgaaacccagcccagtgctcttactagttagatctcatctttatatactgaattcattatttttatcttccaagatcagaacattttcaaaagaaaagttaagtaggaaaacagagcagcaaacagaaacatccgagggtaagaggctaggcatgtggcctgggcaaggatccctgaggggaaagatgctgatgaagatcctatttgtgttcacttatctttactcaaaggagacaataaataaataaataaataaagaccagatgcccttttcaccctatcttacattcattcctcttttccattgtcaatcctgtcataggcagaagatggaaaggcgaaggcttcatagcaagagctgatcaaagataaagttagaaggtcagaagacatgcagactctgtagtggagatgtggcaccacaaacactgcttgggcgttagacggtcttcagttggcttcccaagaaagctgtttactagatttgtgaccagggggatatccttggagcctcagttttcatatcttcataaggggaaataataataatacagatgcctggaggatcatttgtgaatacctgcaaaatatttcccacggggcctgttgccaacccagctcacaacggtccactcaacctaatggacgttgggatgttgaaatgtaggtcactcttttcttcaaagccctttctgcctttctacagtaaagagatgctgggatatgaaagagatttgaaacaactaattccccaacttagactagaatgcactgaaatagagagagcgggggagagagggagagagagagagagagacagaaggagacagaagaaagggggaagaggagaggagagggaagaagagaacagggctagaatggaatgagttagtcaggagctaattaatgaccaaagatgaagaaaagaaagcaatgcaaaaaaatgaaaatgcagccaaggcagagcacattggataggactatacttaacagagaaatgtcttgctgttgtgcaggcttcctcaatctaaaatagcatgggtggccttcattcatggccacgatcactgaagtggctctgaagtgtctttgtacctgtaaaaatgggcttgttttgattttttgaacatacaattaaaattgttgtctttattgtaaaggcccatgtttcatttaatagtctaccagaagtatgaggacatcacttaaaaacacttaaattagaatgaaatagtaatacaaataaaaataagaaaaacagccattttattgagagtttagctgagttgggcagttacttgtttccctcattatctaatgttgaattccaggtagcaggttctatatttctgttcattttagaaatgaggaaatggatgtttaagaagttgagtaacatccgaaatatcctccaattattagctgacttcgggattcagtcctgggtctgcctgaccctagacgtcagtgtcactaaccactatgttaggaagaaaatataggagatatggatgaataaaggtaatcttcttccacacttgggtaaaatcacaagcttgggagaattgacaccataatgtaggaattcttccttggacaagctgaaaatcattctatttcggtacattaaaagccttcacgctgttaagattttggagaagaatgagcgaatttggtagtgtaactagcaggcggggaaggactgtcccttatggcttagcaatgagcagcagggcagttcacaatggcgagacgcagacgcctttggggcggtgcagccagagcggagtgcgcctgggactgagtgtcctcctcggggactgcatgggccccgcaccgccgcctgccccgcgccacgacagcccagagcacggatgggcccagactgtcctacagccgtttcagcaggcgagggtctgtccagcagcacctaaacagcttttgtatgtcctgtctccaaagtgtgtggctttaagtcaggttctgtgcttttgatgacaatattttctttgggtcgggatcattttcatctgttgccccttctgcccaacctttgcacttccccccgatcctcctcaccccttcccttcctctgcctgtctgcacaccaacgtccttgggctccctcattctccagttcttggcttggtctgactggggacttctcacacctagcttgtcgtcgcgctctagggccattgcatcttggttaaaaggcctgtctctgcagactgaaggctctctgcgggcaggaccaggccagtttggcttctccctgcccgccctcggagcctgctccaggtatactggctgaatgttctgagagacccgcagcccaggattgctgagtcgcttgtgtgtccgctgtttacagctgtgcgtgcgtgtgtgtgcagggaaacagccaggcagatgcacatggttatttatatcttcagattatttctgtgaggaaaattctatcctggtgaaagagcttgctgttgaaaaacagtaactgtacccatatagacaccacagtattcgctcaatgtatttgacagacacactcatattgtcagggtaaaaggaggcagcagcttctttgaaatgcagggacagagcaagtgacaaggaaaaaaccacacagcaggtatgtccacattgttgtgcaaccaatctccagagctctttgatcttgcaaaactgagacagcgtacctattacacatcaaactcctcgttcccagttctcctccagcgcctggcagccactattctactttctttctctatgaattacattactctggatatctcttccaatttttattatagcctgcttgacgttgtaaagaaatcaaatgtttggcccagtagccattctcctctctgcttgctccatcacgctgaaaatcaactggtagcttcagctgtagcagacggagccctgagctctcctgacttgtacatgcgcttgtaagtacacaaaatgccctgctccctagtttctgcctgcacgagttcctccatatccctgccccagggcttcctgctttactttctcctcacatcccttcctgtagactccttcgcaaaaaaaaaaaaaaaaaaaaaaaaaaaaaattatgtttgcctcatgagctcccagggcacagctttgctgcctctcagctgcccagccgactccactcgcaagaacagtgtgttcctgaatttttttaataaaataaaataaattgtacttttatattatacattataattgagtgtggtagaaataaaatttaatttcaggtacttttgataatgtggctctggggtttttactgaaaaagtaaaaattcaataaaaagtattctttagggaaatgtgtttttaagccttttagacacttaaagctaacttttattaggggttcattcacagactgtacacttttatgatttctattcatatttttctcacttttgcttaaaaaaatcttttcttagagaagaactgtttttccaataaaaatggaatgaattcccatacattagtctcttctctgtaagtgcccttctgagccccatgcacacagaagagagtgaagaccagtgaagctctttagggagctaaataatagatgcagatgagtgtctaacatctatacagactaggttcctgataaacattgaattgaatctcctggcaggccagggtattaatctggggagaaggaaagccatgtgagttaaaaggggaagtatcacagaacagaagcaaacaatagtacctgaagtaaccttagcaataatagcctaatagcaaatgaagaaaaggagagacgggaaaaaataaactggcaccagagacccctgggaaagactcataatcagaggtaccaataaaggcaaatgtaaatacagagcctcagtcttctaaggcctcaggctcagaaattttacccatggttgctagaccatggaagtcactgtttcctttatcttggaggcaggctagactgaaatgataaagaaagaatctggactctgacatttagatttacagtagtgcactattgtttgtaagggcattattgattagagtagggcaaaaagatgggccaacataatttgttttagtctatcctgtattatggttacttgtttgtctgccaccaactatgaaatgtgactttaggaaagcaaatatggctatcattacatcttgttataataaatgaataaaagtgaatcattttatcattttcaggtggtcaataattgttgaaatactataatcttttatgcattttttaatttttatgaaatattttcctgttcctccccaaaggcatataaaatattttgctttcaattaaaaaattaaaaatattacaaacaaaacaatccttgccctctttgggctttcagagtatgtagactttctaaaaagtctttgtagtgaaataaaaaatattttaaaagttaaatgatgtctttagaatatcttaattttattttttgttgttgtgggtgtgaatattattaattttttaccgcaggtccttcttaaaaaaataactaatagataataaaatctatggagaaaacaatagctttaaaaataaaagtctttgaaaaaaatgagcatggttttcaaattgacttgatccaatcaaactcttatgtctcctttaagttaaagatgctttcctagttccacatgaaatcacttataaaaagaaaaagtacatctatgccctggagaattactcagtgagtatgtcagatccttcagttataatatgtatgggcacataaaaatttataagtctcagtggtatgcaactgctcaggtagttggcatctgaatccttcattttgagagctcaaaatattttgtgagttcaggtgactttgacttcttcagtaaatgtttttggcattttgggcccatctgctccttggtagacacagttctaaactctggaaatacaaaagaattctgatagctaattttgaatcttttctaattttgaatccataactatatatattcattatatatagtgcaaaatatcacatatatgtatacatgtatacatacataatgtgtgtgagtttataaatatgaaattcatcaggtgctgtggctcgtgtttgtaatcccagctactcaggaggctgaagcaaaaaaaaaaaaaaaagtttgagcccaaaacagtgtgtgtgtgtgtgtgtgtgtgtaattatatttacttgaccaaggaccaaggatgctaccttaacttgcatttatctttacaaaaaaatagatggcttaacctagtatagtttagatcattcctagttttatttttagaaaactaatcaagtggatatttgtctattaacacttatgtccatgtttcctacaatactcatagaagatgtcagaatacttcagaattagtattaaattgtgagagatgggaactacagtaaaattgatgtaatccaattcaattgagttgtaaagttattgatttttaaaaagcattaaacattatgcactgtgtatacttttaatacagtttttcaaaggctacagtgcttgtctaaagttataccaatgaacctttataaatgcagtttcctctcatccctacccaaaggatgcttcaggaagagggggatttataccacagtcatttcatggaccgtaaaacctcaagtgttatgccatagttatgcaatcattttgatgcttgacaacttgtctttgttacataattatattatttgaaactcagctataactgaaaaaggaaaaacattaacataggaactttctgattaatcattgtaaacagcgagttgtctattcatcaagtaaaagtttagagaatttgaagcaaaaataaaatatttgcacatttttcaaaattcaggtaacatctttataaaattgtgcatttaatgtgctttatgtgtatatatcatttatactgcattcaataagaatatcaaattcagtctttaaacataaataatgtgaattttatatatttaaataatccttttgttttttggatttctaaatacaaataatctcgtttgctttttattattgagaaatttatgagatcacagcttacataaccaaatgagataatatgtataagagcactgagtgtggtgcctaaacacccaataattcactgctcttgccctggatagccctgacttaccagctgaaggccaacatgggtccttgtcagtcacagcaaccaacagaggcccccagagagggctgggatggtgctgtctacttcactgccctgatgcttttaaaaggtttgcagaacagtggtatagaataatcacagttattgaattcttgtcttgcccccgtttaaagtaagaagataatgttgctctactgaaaatttgaaactacgtttcattttattcatgagaaaattcattcccagtgagatgaatggggggtactgttatcctgtggccttggtaggatttaactttcatggatgtgccagttcagtttattactctgaggcacaattctgccttgttctcttctatagccactgtatttcttactatccattatactagttttcttttgtgacattttatctttcaaatattagattaaaaatcctgtttggaatgaagctcaaacatttggcattatagttcatgttgtgagaatttcttgtttttactatttctaaacaatatatttctcttggattggatagggtcaaatataatttttttatttttatttatttatttttttttggtgagacagagatttactcttgttgcccaggctggagtgcaatgacatgatctcggctcactgcatcttccgcctcccagattcaagcgattctcctgcctcagtctcccgagtagctgggattacaggcatgtgttaccactcccggataattttgtatttttagtagagacggggtttcaccatgttgcccaggctgatctcaaactcctgacctcaggtaatccgcccacctcggcctcccaaagtgctgggattataggcgtgagccactgcgcccagcctagatagggtcaaatataaattatttccagtatcaaatgaatgacttgagatataaaattttccttaatgttttacacctaaatgtataacttatatggttcaattacttgtattgtttgttgtaaaatcttatttaaaaaataaatgttgtttttaaattttatttaaaaaataagatcactacatttcatgcaaagtaagttgaagaatcgatactttatagtaggaagagaatcagcatgctaagtacagcatgctaagtatagtttaaggaattcttacatggctgatttcattaaaaggttgcccattccccaataatagcattaaaaatgtttggctggaggtgtgtcatggaaagtaagttgtctcggtaatcttaaaattgtaagcatctgtatcataaagcaatctgttcttctgttggagtatgttttttttacctctgccttaccaatttccagaaggaaaattgtctgaaagttgtttttggttgaattctaattaatcagctttccctctggtggccaggattagattcctaaggtactaaaatgtcataataatgaattgagaatgaaagtttcagaggcacaaagtgatggttgaaatatactgaacatgttttaaaagtggaagcagccacaatgtttttttgtttgtttgtttaatttttattgttttgagacagggtctcactctgtcgcccaggctggagtgtagtggcacgatctccactcactgccacctctgcctcctgagtagctgggactacaggtgcgcatcgccatgcctggctatttttaagagagatggagtttcaccgtgttggctaggctggtcccaaactcctgacctaaaatgatctgcccgtctcggcttcctaagtgctgggattacaggcatgagccaccgcaccgagcctacaatgttttaaatctattaaaatcaatattgaaatcacatttcttattatctctggagaggatattaacaatattaagttgtgataccattttgttaatatagattaggcttttagttatagatgacaatagaaatttttttatcattacaatatgaggggttaatgactaaaaatagttcatataaattatattacataaaataaatacagttaaataaggcgcataaacaatggcaatgcaagttttgataatcaaattcactactgcaaataactcagcagaagggatggttttcttcagttatttggtggcatattctctcatgataggtaataccaaattcatgtgattgttttttaaactttgattatatttatagacacctgtttggcattcattccatgatgataatgataatgatctctatttgacttagtaaatctgatatgacctttatattttataagtacatatttttcatgtatcaaaggtttcatagaagtctacttattaaaaatccaaataatttctttttataacaaagacctagtgagataggctttatagaaaagtgttagagttctacaaataaaagaattaggttcatttgaatttattgaagtgaacaatattttagtattagttctattataaaacatcctaaaaactttcaaagcaaaagttgtgctgatcagacctatcgaggtaagtttctggcattagggtaatgtataaaataaaaaaggggaaaaatatgcccagatcaacagaaaaactgcaataatctgaatttcttgtgccaagcagaactgtatatattttacttccactttcctgataaaggatctaattgggtcactgttcttcagataatgaagagtgttctacagtgtgggtggagcactcattatgaccccctctcatatgactggcctgaattggagtaagattctaattatcgattaagtcaattgtggttaagctggaggtatcacaccaggcaaatcattgggattgtgcaatattaatgacttttccaatttcttgtgttgccaattttatcagaatatgtgtacatgatactcagtatagcccagattaaataataaacatctgagtggccatgcctgtaatcccagcacttttggagtggttcatgcctgtaatgtggttcatgcctgtaatcccagcacttttggaggccaaggagggcagattgcttgagctcaggagttggagaccagcctgggaaacaccataagacctcatctctacaaaaagtacaaaaaaaaaaaaaatagccaggtgttgtggtgcatgcctgtagtcccagctgctcgggaggcagaggtgggagggtcacatgaacccaggaagtcaaggccatgatcgtgccactgcactccacttgggcgtcagagtgagccacggtctcaaaatagataaacaaataaataaataaatatgtaaatataaataaatatctgggtatggagaagaaaagtcttctgtaatagatgctgagattaaaatgcaagagtatcccaaaattcctagctagaatgagcaattccatttgcccttagcttatgttgggaaatgaaaagtaggttatgtttggaaaagtatgacaaattacattttggaaattctgagtttgaataacatgttggtttccatgaggagatacttccaattaagttgaagtgtcatactggaccccaggaggggggagtcatatctaagcagatggtgaatatgtagtgaaaacaatatatataagagtgtcaaatacaaaatcataggatgcctgaaaaattaagagtataaataaaacatacaagaataagaatgagttagaagaataatttccagaatggcaatgtgaaacaaccataaaaattaaaattataaaacaaaagtaaataaacaattatttaaagtctctggaaattatctcaaaggcatactgcaggataagatacacctaaaaagagtcttcttggggtcacaacaacctcaaaatctgtttccaaaatctattcttgaaatagggcccaaatttaattggatcagacagtggaacaatttatgcccagagcatttttgaatatagttgtgaaattatcctgaaattagtggacgctaacagcctgctataatattaggtcggtgcaaaagtaattgtggattttttcctttaattaaattaacctttttttttttttttttgaaacggagtctggcactgccacccaggctggagtgtggtggcgtgatctcggcttactgcaacctctgcctcccgggttcaagccattctcctgccccagcctcctgggtagctgggactacaggcgcccgccaccatgcccagctaattttttgtaatttcggtagagccggggtttcaccgtgttagccaggatggtcaaaatctcctgacctcgcgatctgcccacctcagcctcccaaagttaaattaaccttttattaaaggttatgccactacctttaatggcaaaaactgcaattacctttgcacgaacctaatattagcaatgaaggaaagaaagagtcaaaagagttctattaaaaccattgataacccagggtgactgtacacaggctcaaggctgtgacttgtgaggagtgacaccagagactgtacatggcaggaaaagagactccagagaaataatctaaccaagtagctagagaaacagacacaaaacaacaaaatgccttgggataaaggggataaaaatgggcgtgcagagttgttacaatatattatctaaaatgttcaattttcaacaaaaaaattaggacacaaaaacaaacagaaactgtgtcccatacatatgaaataaaccaagttacagtaacttctagatgccagatttagcagaagacttcaaagcagctattatcaatatgttagaagaattagtgcaaatgatacacagagtaaagaagtgtaggatgacaatgtctcatcaggtaggcaatataggtaaatagagaaaattattttgaaaagaatcaaatgaaaattttggagttaaaaagcacaatcaataattgaaatgaaaaatacactacatgaattcatcagtaggtttgagctggcagaataaataatcagaaaatttgaatgtatgttgctagagattatgcaatctgaagaacagagaaaaagaaacaaagaaaatttaatagaactttagagaataaccaatgtatgaataatgagaatgctttgcacaaaatactttgatataagtgaaaatgaagtcacaacacacaaaagcttattaatgcatagaacttaagcactacatagagataaatttatagattatatgcctatatttaaagaacatttcaaatgagtaacctagtctttttcattaaaaaatgaaaaagcagcaaaataaacagaaaaaaggaataaaaaagatgagagaaaaaatatagtaacagtaatttactgtatatttaaatacaactgaaagagttattggaatgtttctaacacaaaaatgtcataaattcttgaggtgatgcatacaattaccctaatttgatcattatagagagcatgcctatgtgaaaacatcacctgtaccctataaatatatataactattatgtatccagagtcactaaaaataaattttaaaaaatgtaaagtagaagatatagaaaattggggaaaccaaaagttggttctctgaaatcattttctaaaatcgacaaacttttagctggaatgaccatttaaaagagtgaagattcaaattactaaaatcaagaatgaaagaaagatcttaataatgaccttacaaaattaaagagaatgataaattagtaccctggaaaactgtatacaaataaattcaataacttaaatgcaacgaattaactcttaaaaatgatataaactatagaaattgactcaaaaaacagaaaatctgaatagatatataagcagttaacagattgaattattattttgaaaacttccaacaaattaaagtccaggttttactatacctttcccttctggtgaattttaccaaacatgcaataaatagtcaatataatttttagcaaaatctttctaaaaacatggtaagatgaaacacttcccaacttacattatgaggcgagtgttaccctaatgccaaaaaccaggcaaaaacattaaaagaaaactacatccccctgtctctagaaatatagacacaaaactccttggttaaatactaatgaatctaaatcagcaacctattaaaaggaatatgcatcatgaacatgtttgatttatctcatgaatacaaggtagttttaacatctaaaaaccaaacaatgtaatatattgatacagtaataaagaaaatctgtgtaattatagtaatatggaagtaatataaaagaaaagcatatcacaaaagtcaatatcctttcatggtagaaacactaaataaattaaaaacaaaagtaaactttctcaatttgataaaaagtatccatgaaaaacctatagctaacataacttattgtgtaaaacagagtatctttcctgtaagatcaagaacaaaacaaggatctgtgctcttgccacttctatgcaacattattagaagttctagcaagggtaattaaggggaagaaaaaagaaatgaaagaaagaaatacaactgtctctatttagaaatcatatgatcttgtacatagaaaatcataaattcaccaacatttattaaaacttataaatgaattcagtaaattatatttctatatactataatgaacaatctgaaaatggaactaagaaaaacaattacaacaccaacaaaaggaatgtaagactgaaactgtaaataattggatggcaacacgtcccatattgatcaaaagattttatacaatctttattagattctagcttggttacttatacaattttgcagaaattgacaatgtgatttgaacattcatatgaaatgcaatggatccagaataaccaaaaaaatcccctaaaagaacaatgttagaggcctcacaatttcttacttcttgtatatatgtattacaaaactacataaaatacataatgtattacaaaactacaaaaatcaaaatggtgtaatattggcgtaatgatagacatagaggttaatggaatagacttgagattccataaataaacacctatatttatggtaaatctattttcaatttgtgcacaggcattttaatggagaaagaagtgtcttgtaaataagcagtgccaagacacatgtaacatgattaagtttgactccttccccacataacaaacataactcaaaatggatcataagcataaataaggcctaaaactacaaatattattcttagaagaaaacatagaaggaagtcttcatgatggtgtgttatgggaagacttcttagatatggccaataagcttgagtagcaatagaaaaaatggacaaattgaacttatcaaaataaaaatcttgtattcttcaaaagacaccattaagagaatcaaagggcagcctagaaaactggaaaaagtgttggcaaattatgtatctgatgatagacttgtatacagaatacatgaagagcttttacaactcaataataaaaagacaataatttaacttaaaatggacaaagagtctgaacaggctctcctccacaggaggtatgcaaatcaacaataaacacatgaaaaagatgatcaacatctttttacctgccagttgcaaatcaaaaccacacaattaaatggcatttcatatacactaggatgcctgtgatcaaaaagaaaggtaatagaaagtgttgatggggatatgaaaaaattggagccccgatgcaaggctggtgggattgtaaaatggtgcagccatctgtgaaaacactctggccgttcattaaagtgttaaactgtgaccacacaacctaggaattctactcctagggttatacccaagagaaatgataacataacatttatccacacaaaaacgtgtacaatattattcataatagccagagggtgaaaataacctaaatatccatcaactgataaagagataaacaaaatatggtacatctctataatggaagaatatttgagaataagaataagaaataagaataagaaaaagaaagaagaaagtaatgatacatgctgtataactgagatgagctttgaaaacattacgctattgaaataatccagttacaaaagagcacatatgttgtgattccatttatatataatgtccagaataggcaaatccatagagacagaaaataggttcgtggttgccagcatatggggtagagaagaatggggtgtgaatgcttgtgagtacttctctttggtatggtggcatgttctaaaattagatagctgtgatgtttgcacaactgtataaatactacaaaccaatgaattatggcatttaaattggtgaatattagggtgtataaattctatcccattaaagctgttaaaaaataatgtctgaaaggagaattcttaatgatttctcctcctgagctatcattatactgtactgtttccacgcctcccttacaacatgtcttcctttgcgggaacagaactggaacacactggaaacttatacatatctgacccatatttttggagctatgtaacatagatttgtaaatagaaagagactttccaaattacattattgtattgtaatagttttcagaataagaatgtaagaagataaaaaatattcagaaatggtaccacgttgtataataggtcaaggtgtgtgggagaaaaaagtaagagagttgtgaataagcaagttctacagggactaactgtacctccatttgtagcaggtccaccaccgggcactaacttggcaattttgcatattaagagtccattttacatattaggatttgatatatttcttaaatttggggaaaattttttatttcaaatgtacagaaatttgcacacttgatttgaagcaagttaacttttctattattagagacacttcatagttaactaaaccttggtgggtataagccttaagtgcatacagggagcctcagcaaccttgttacctggaaacaaactcccacacatctgcattgacaaatgggtggtgttggaagaaacttaaattgcctttcatgatagtgcctaccatcagcagaaagggggaattctaagcagcatgcttgtcctgattaaatgctttgccatcgctgtatgggtggaagtgggttttatttagtaatggacctcttgagaacaattatgttttatgtattgctttaagtattaatttataaaaatagttcaaaatataatgctgaaagcttattcttagtaaagtgctcacacatactaaaatcacctttattagaataacactagtgataattatattttgattttgcatttgttcactttcttggctagagattaaatacatatagatagaggaagttgaaagcaaagtattatttctgcagaaatgtgtaattaataaataccatttacatgttttaaatcttttttttgtggaaaaaacactagtcattgcatgcatgcttatatgtatacttaaaattatcatatctttaagaagttcaaggagaatgatacataagggttttattcacccaaaaggtgggaataagacttttctctgggcttatttttcccaccacatgcatgggagtactggcaggtgcaaagcccagagtgaggtcagggccaaagcgggaggggggcactttacaaggttctctaagtatgattctttgacactcactctatttatttctttattttcagtaatagcttttatttaaaaatttttcttcctctgttgtaaatttttctgaggttttttttttgtcgtcgttgttgttttattttcattttactctaagttctgggatacatgtgcagaaagtgcaggtttgttacgtaggtatacatgtgccatggtggtttgctgcacctatcaacccatcatctaggttttaaacctcacacacattaggtatttgtactaatgctctcctctccttccctcccacaccccgaaaggccaagtgtgtgtgatattcccctccctgtgtccatgtgttctcatttttcaactcccacttatgagtgagaacatatagtgtttggttttctgttcctgtgttagtatgccaagaatgatggcttccagcttcatccatgtccttgcaaaagacatgaactcattcttttttatggctgcataatattccatgtgtatatgtgccacattttctttatgcagtctatcattgatgggattttgggttggtcccaagtctttgttattgtgttctctgggatttatgttgaagagtggtgttgattattgaacgaatgaaacattagaaccattatattcctgttgaaaatacctttgaattcttaagcatgtaaacatatggggaaagttctcttcctctcaaatcctttctaccctctacctttaaccttctagtccctcaggatatccattatatagtctgtagtttattgaattttactacaagccttttcagtgtttttaaattgtgatgggtgtatatgtgtacatacaagtatatggatatacctataaaacttatttcctgtagtataatatgcttcgtcttagtataattgagacatgaaaaaataaattcttctttcctattatccacatgatattgggtataatattcaagattattatttttattcttctttttttttttttttttgagatggagtctcactctgtcacccaggctagagtgcaatggcccaatctcggctcactgcaacctctgcctcttggattcaagtgattctccagtctcagcttccatagtagctggggttacaggcacccgccaccatgcccggctatttttttttttttttgtatttttagtagagacggggtttcaccatgttggccaggctggtctcaaactcttgacctcaggtgatccacctgccttggcctcccaaagtgttgggattacaggagtgagccaccgtgcctggccaagatcattattcttataatggaactttataaagagctatgtgctgaattgtagtaacccaagaaatacggattcatggctaaaaaaaactgttaaatattatgtaatataatctcctcactttgactatagctactcattttttttttctctgaacctaagaaacatcctcatataatgagatgaaagatgacaatgttttatggaggaaaagtcaggaacttagtaagacactgaatgggctaaagggtacctcaaaggtagagaattaaagataatggctactttttcatttcatttagaatcatcccagatcttaaaatgtagtaaaggacactttattatttcaatgccctcatgggtcttataattaacagaatgtaagtgctaggaaaaaggtgtagtaattgcatagccaaatcacctcataatttaaataagaatgttgagtccaatggtaagatgatgtgaacttggccttttcttttaacatgtgagaatcgagagattgtgaaagactaatggaaatgaagataataatgaaataagagaagaagaaataatcagtgaacagaggtttcaaaaattctggagtgaataaaatcctgaactctggtgaagagttcaacattaagattggcaaggccactcaatggagtgtgaaacagaaaatgaaaaaaagaaaggacagttgcagctatatgaatatttgtgggagtttagattaatgttgatgttatttttaggtggctttttaaaagaaaaatacaaaataaggctatttgctgaaaataaatcaggtggccagaaggttatgtttgagaatagagaaattgttctgaattcttgtctactgagaactggagagagtattgacatagaaggattagtgggaagagctaagaacccagtggagtctggcatccacaagacaatggtagcactgatgtgtgcatttgtttaatttttctccaatagcattcagcagttcagggtttttgcagagctggcagagaattcggatttattcaggtgaggtcccctcacacacaaagtagcaggtcagtgtaaaagaatactgcagtgaaaatgttcaggatattgacagagtaggcattggaatctctgctcattagagagagaatgagaagtcagctctagaggagcacaccctctgcggtgtctgtgtgggtcaccctccatgccttatgctcaggcagggctcattgccttgtcaataaatcctcattttactctgtcacttacataccatttattcagctttgtattagctgatcgcaagatactcttatgccctaaagttttttctcatttgatgcctatgcatccatatctttaagcataaaaactgggtatgttttaatgaatctataacttcatgctgatagccagggagtagaactagaaggaaaaactgcaagtagaactctcaattttacagaaaaagatgaaaccttagaaattagttactgtaaactagaaaatatatgatatttacttttattattaaaattgaattttttggtttgtcttttttattgccattttagaaaactttcttcatccttccattttctcagatttatatataaagctaaataagatagaaggtttaactaataatactgcttgttttcttctgagatgatatgatttttgtaagagaggagaaaaggccaaatcaccaaataacttgcattacaattcttggaaataaggattgtaccactccttattattcaataagtgtatcaaggtaaaaaattaaagaagaaacagtaagaagctttttttttttacctccacaatgtttgttgaaacattctttaaagaaagagcacttcattctccatgtccttgccttctccttttccttcagttctaattttatccaaaagcctcatactgcatcttggagagaaatattttgtcaccataaagcttggaataaggacaagcttaaaatacagaatatactttctaataggacttcttaaaatactacacattaaaataaattttatttgaataaatgaccaattgccagtccaaatgtttatttacattatctagattgtctggcaattatctagatagatatgccaacacttttcactactttgtcccatcaaaagggttattgttctaatatctatcatttcacagaccttgaatttttaacatcccggaccttcatattaacaaggaactaagaaagtttcttgctttctgatataaattccaagatagaagctcataattacatagtttttagattgtggcaatcctggaataattataattgcatagccaaatcacttcataacttaaagaagaatcttgaggtccaatagtaagacgatttgaacttgttttatgctatttaatagacttattttatccaatgtctgtgtaatgagtggcacacctagaatataattagctttttaaaagggagccttctgtgagctacttacttactttgtcctttgagaatataaaatttaagctgtatttacctaaactaggcaactctgtgactccacgaagctgttctctgtctaaatgaacactgaggaatcagaattgtacacattttattgtgataattatatgcatacaattgtcttgggtctatccaaagctgcaccatccacttttgtatctcaccccattccctctggcctattcaagagcatcgctttccataaattctttcctttttctattatatctttagtccccatgccttcatagattattcccataagtatataaatatattgttattttttcaatcaaaaaagctaaaaattaattttctgtaattaccaccttatttctctgctcccttaactcagaggagtcatgtacttcctgtatctaaatccttccctcctttatttcactatgaattccttcaagtcctatttctcccacctggatcactgaaaatttttaaggttaccaccaagccttatgttgctaaaacaataaacactcatcttagtgagacctagtggattagcaatgagtatatttgtcacaactgatcattcccataccctagaaatattttatcacttgacttccagaaaaaacttgtgtcctggttttcctacaatctcacaagttactccttcttagactttttttctgttattgttgtttttttagcatcttgatcttgagatcttgtagtgtctcagtcattagaaatctattgtttcatctggtttcatgtctttagagattatgctaagaatacaatttcctagtcaaccaagacttctcacctgaagtctagacgcatatacagtcatcacttttcactaaataatgggaatactttctgagaaatgtgttgttaggcaattttgtcatgtgaacataatagaggatacttatacaaattgagatggtagagcctactgtacacctggtctatatggtatagcctattgctcttaggctacaaacccatacagcatgtttctgtccttggcaattgtaacagcatggtaagcatttgtgtatctacacatacataaacatacacatacataacataggtaaagtacagcaaaaatacagtatataagatcaataacggtatgcttatattgggaacttaccacaaatggaacttgcaggacttgccgtggctctggataagtgagtgagtgagtggtgactgaatgtgaaggcctatgactttacttactatacattgttgtagactttataaacactggacagccaggctagactaagtttataaaacatatttttctttcttcaataataaaccttagcctgctgtaacttttttactttataaacttaatttttttaactttttgactctgtaagaacaaagcttaacacacagacacattataaaactgtacaaaatattttttaatatctttactatactatatgttttattttatttttaatttttttctttactacttaagcattttgttaaaaattaagacacacacacacacacacacacacacacacacacacacagtatcctaggcctacataggttcaggatcatcaatgtcactgtcttctgcctccacatcttgtccccctggaaggtcttcagggacaataacaggcatggagctgtcatctcctgtgataatgatgccttcatctggatacttcctgaaggacctaactggggccattttttagttaactattttttgtatatgtagaagtaataatgatagataatgataaaaattgtagtatagtaaatatataaaccagtagcatagtcatttattatcattatccagtattatgtactggataactgtgtgtgcagacttctatagactggcaacacagtctataaaatggatttgttgacattcacttgtgtaatgcattgcttgacactgtgatggctaccatgtcaccaggcgaatggaagtgttcaactcctttataatcttacagaactgctttcatatatggtgtttctttaaccgaaccatcattgtgggatgcatgactgtacatgtagttcaacgtagatcctcagaggtctaaaaagaatatgaagttaagatatccaaacctaatacttgatttttcctctcaaacttttctacttttctttaacggtgcccagtttcacagttgctgaagtcaaaatttttcttctctttttctccctctacatttacatcattaagagtgtagcagctcattgtctcactgcctctctgctgcaatctcctctgagcagcctgggtgagtacggtcttctgcctggaagcagagtgtttcctcatctgtcattattcactctcctccagtctattcttgacacaacagccacagtgatcttgttataataaagtcaattcaagtctgattagtatctctcagtgacttacatctcactctccatggcctatgatgagtctgaccattcgtccctattctttttgaacattctctaggcctacatgggcctctttatacagtgctttgcacctgcgattccatgtgccagaacactcttcccccaatgtctgcatggctctccccatttcttcctggggcttagctctgatgtcaccttcactgccagggctttttgcccgtttcctgaatccagggctcggctctcccaccgagccagtgcttcctgtttccaccttctgctttattttcctctgtggtacttgatattggctggtataataattacactgaatatttcacctaacttcatttgcctctgtccactagaatggaacctctttttaggaacttgaatgattttttgtcccctctattttgtttcctgttgtattcccagggcctcgatcagttcctggcttaatacatattgttgaattgaataattgtatctggtattgacttgcaatccttcttcactacaagagaaataaatcattagtttggtaaggccaagagaaagtctgttcattcatttaacttttgtttttcatttagtgctgaccatgatgactggcaccgtgccacactggtccagatgtcatcttttcatactgcaagttcctgccatatgatctgcttctgtttttcctgcttgtcattgtgttgaaatgattgattgcttacttccgggcttttaatatccatagcaaagacatttccatctctttctgactgacattattccagttcagattttaagcagaagtatcatctagtatatttctaaaaatctatcaagctctattcctccgagttttaaaatcacagaatgctagaagtgcctgtgtgtattttgcaaactgctgctcctccgagttgttctggaatgggtcttatttttttatgttgtgctttagttatgtttttctccttctctactcccctttcagattctttgtacaatgtaaagggtgtttaaagacttacatttttgtgaaaagaattaaacttcagtgcataacctgacttaagaaaagcttgcctgtagtgcaaatatcacagactctgtgctacttctcataagcaatataaaatagtctccttggctgcaataattgaagcttttacgctctcgtgcccctaaatgtcacataaatgtataagaaatgtatctgtgctttacaaatgtagtcaaaaataactgctccctgctagttacttaatgtacttccttttattcttgctagagtcctatagatctggacaagaggttatccttcctgtcagtagcagacaaatttgtttattttaggagaacaagtgaaactgtttcaccatatctgaactcttggccctctgaaaacatcagagcacatttgccaagagatagagttgtcaaagcctttcttttgccttcaattttctttccagaaacttatgttaaagataaacaaagcaggacaatagttgacatggtaaggacagattttaatcagtcatacgccactgcattagggaaaagagtccagggtgagctgagctcaactgtgacttgtgcagaaatgactgtgtgttacacaagaagaacaagtgagtggggagtgggtgtgcaggggcttagtattcagagaaatggaaaattacagaaagtagaaatgagggttcggtctgtgtgaaacctatctgggttttttaattggtgcttattgaagttggattcccaccctcccacagagactgagagatgaggatcctgtcttcaggtgtcggctgaaacaaacagtaaactctttgggcagccttgagttttctcaggacagcacttttagggggcttatggtgagcctaggaaggtggccttgaactgctagaaactatattagtgtttactgaagtctttataggacaagagtgaggccttgtcaaaagagggcccagaggagcctggctagagttcagtcaaggagagaacactcatcatctattgtcttacatacctctggctcattggaactgtggaggcaccaacaactttcagagtttcgtggattttcaactcctctgtatacatcagactgtatattgttgtgaaattaaagcattaagttatcttgcagttctaaacttctgtgaattggttactgcttggtgaagtgcaccaataacttccctctgagaatcaggaagtagcactctgctaaagtgtgccatgtcatacccagagacctcatagcttgttcaaggttaaacagcgagtttgcagcaaaacttatggtttgtagagtaattccacaaatatcagtgtatttgatttatacaaccttcttaggaagaagacagggaactgagctatgttttgtagataagaacaataagcttagagaaagaaagtgcttgtggaaggtgacccagacagtaaagctgacgaatcaggctgggaaggaggttttggggcttgtagactaccgctgtttctgagcggcacttcacctaatcaggtttgtcatgcacttagcaccaccaacactagacatatttcataatatttaaaagtcttattactgaatctctagaaactatgaagaaacaaaggtaaattgaaatgatgagaataagatgttgcaggaaggtaatatatcacaaagtgggtatttttttaaaaggcccaactccaaatgttttcctccttcttcagatacaggacctcgtgcttttgtttagccatcggcatagtccactgtatttttttctttctgattttccttaatccatgttgtcttcccaagtaccttgtgatcttctagaagataagagtggtatctcttattcatatgtatgtagaaaaaaagatttcaaaaactcaatattgcctgtttttctgtgagttggtttatatattttcagtaataaaagtgcaatattttataatatgaacagtcatttaaggtcaacaataaaaacaataagcacaattttaatattttattacttttttctttattttagaaagaaatataaaactatattgggtggattacttgatttttctgtttgtttccagtgagttttgctcaggtttcaattcttaaatttatttaagagattacacataacacctcctccaaatcaggttgatatgaatgttgcataataacagaataaaagttaccctatgatgatatgacccagcaattttgttacaaatatatacccaagaaaaataaaaacatatgcccatacaaaaacgtggaaaaatgtgaatagcaacagaatttgtaatagccaaaaaacagaacaaacaaatgtccatccacagatacagggataaacaaacagtggtatttccatacagtggaatattatacagctgtgagaagggaaaggtactgatacatgctacaacatagaaatgaactctgacaacattatgctaagtgaaagaagcaagtcacaaagtcccacatattatatgattccacttatatgaagtgtgaagaataggcaaatctatagagacagaatgtagattagtggttgtgaggagcttaagagataataggcagtcatatctactgggcacaagcatttcttttggggtgataaaaatgttctggaattagattgtggcaatcattgtacaacttatgactgtattaaaaaccactgagttgtacacttaaaaggtgaagctgatgatataaaaattgtctcactataactgttataaaaatataatggcattttatatttgttcaaagtaaagggcaaggaagatatttattcttatcacttaaaataaaaatgaaatttgtaactgtcagtgctttttttgccaaacaattacagtggtcttatgtgaaaaacagatgctttagaaaaatcttcacggaaactggcaacaatgatcacttttaattaaattcttgaactgaaaacattctactttatttaatttaaaagataaatttaaatttaagaatagaaggcaatgcattttaaatgttgatgtaattatggaattttttgtcttactttaattaaaaagcaagattacagtgcgaaatttactttttccctgaagaaccttttagaaggaaactctatttagaagatagacattttttctgttgtaattacttggtatttactttttgttctctcaagaggatctgctctcgtatatattaaaataatgtgttaatgcctctagggggaataaaaatgatttggtcattttctttctggaaaacacccaaatgaaaactgtttgctcacttggcatgatcagttagaattaagtaacttccaggtgtctctctcctgttttctggagtctgttactggcccaaaacaatctgggggaagtgaatttcattgtagctgacctaggtttattattctagttaaaagaatttgccaatgatccaaagttttgttagggcttttactcctgttttgatcgtcaggacttgcaaagggtgcagagtatggcagtatgagtagcatgtatatacggggatcaggaaaagctaataccctgaggccatcatctagtgtccttgtgcctgagttatatgaacctaccattaatgatttttgtaaggagtcagtatgaaaacgtacacaaacctttagcataactacctcacatagttgtaataatgaaaataaaactacttaaattccatcctctcttccggcccagggatgtttaacatacattattccaactcacttcacataaattgaggatcactgagttttaaaatatgtttattcctagttaatttggaaaacatgatcactttaagcttttataacaaaagctggtggtttcccaaatctaagtaggagagagaggacaatggtaagtcctagttgctgggaattaaatattttccagaatctagaggatcctcacttactgcaactctgcacccagcgttgtgcttgctcactccaaacctcattctcctcttagtaactccccaacacgtcctttgccattttacttttggtaaggctgactccatcttctcatctttttctccatagaaaaagaaaaattgcttcagtagcactccacccactgacaatatttgctattgtagtgattggcacgtgaaccaatgtggtccaacaatttctatgcggagatttctggagcctttagagaaagaagtaaacttcctttgtctcctgaaataacttccagaagaaatcttctaccctttgagagagaagaagcaccaggtagccctatggctacttagaactaaaagggcaaccagcattagaatgaacccgacacacaaaccaaaccaaaagcacacaaaccaaagcagagaaaatgaacaaagttggtgtttgtaagattattgcactgctgaattaaactgcgcatgaaacctccctgactgttgatttccattagttaaaccaataaatggccttttccgcgagccagatacattttatttttgttgtttctataaatataataaaataccagaaaaagtcatgtatgtttttgtattatttctgttactaatatttataaaaagatacagactaataaagatctaaaatctatttcttgatactgtaaatgataatttacataaatttacataaaagcatacctaaagaagaaaaatatacattctaaactagaaaacaaggaaaacagagcataacagacatatcatcaagagtgttatacaaataaaaactattattttatttttcaaaatgcaggaattttttaaggtaataaatataaattatctttacagaaagattatttacctttaattgaacatatacatcttaaataaacccaaaaatttccttttatgtttctcatattgtaaaaaggaacagtggagattatttcaatacaatgacatagtctacaggtattactgcaaaaaaaaaataattgatcatttagttgcgtatttcaatatggtatatatttgttaaatagaatttaaatagaattttattgaaaataaactaaaaatatgcaataagggttactatatacatacaaatacataattacatttaccttattgcattattttgaagtacaatgaaaatgttgatttacatatacagatccttagttcaggtagtgtaggatgaatagttgaaattcagatataaaaccctccatgtgataaaattagatttgctgatgtgaatattgcctattttgtgactgtaaaaggtcccctaggctatactattttttttcagtatttttctctctactgtttccaatgggtcagttctgtggacctgtcatctagctcaccgtctctgtcatctcagctccaaaactgagcccatgtagcttgctgtatttatttctgttactttacttttcatttccattacttgcacttttttttttttttttttttttttttttgagatggagtctcgctctgttgccaagctggagtgcagtggccatctgggctcactgcaacctccgactcctgggttcaagcgattctcctgcctcagcctccaaagtagctgggattacaggtgcatgccaccatgcccagctaatttttgtattttcagtaatgacggggtttcatcgtgttggccaggatggtctcaatctcctgaccttgtgatccaccggcctcagcctcccaaagtgctgggattacaggcgtgagccaccgtgcccggcctagtagcactttttgataacttctattcctttgttaaaattttctatattttcatttgtttccagagaatttgaaattgctgttgaaacttttttttatgatgactgctttaaaattcttgtcagataattgtaatttgtgatttgtttaattattggtgttctgtgattgtcttttatctttcaagttgtgatcttcctagttctcagtataacacatactttttaattgtgttctgccttttggcttattatgtttcaaggctgggtactatttaagattttttttaaaagagggcatttaccttgtttggatttagcacataggtcctggcctagttttagagactgattgtctggctctattagctgtctcacttttgagcctgtgaggtgctatttattctgaatggtttatcttgtgccaatggggcttcctctggtccctactgatgctgctttgggtgagcagacgaaactatgcaggccaggttgctggtgccactaattaggaaagggatcctttctcacaaggtgactaagaacatttccagcctcgtgcttgtcaagctacgtctgccagttgaaaaagtggaatgatgaggagaacctctcaggctgctcatgggctcaaggtcacctttgcaggtgtttcccacagtgtgatatccctgcctagggtaggggagtcttaggccctaggggactaagtggcttcccaggttgagcattttgtttgtagcagttgcccctgctgctgtctctggtaaatggaatcactcagtgggaggaggagtcccaggacagggaaggagagcaccacttattgccacagggcttctgatcagtcccctctactggtttgcctcaacttgcttggtatggtgggactctatttccacacacatgtggtatgagactagctgatcttccctctttgaggctgcgggtcaggaaatgttaggcttggatgtccttccactgttgcatgggataatatgacatcctacttctgggctgctcctccagttctggcccctacctggcctgctttctctttgaacatttcagaactctccttgggtcgtctttcatttttctccaacatgtctatagttgagcttgtggggaggaggagggagagatagttttcaccatattgtctggactggaaatctctttcattttaaaacgtaggcatttttcttacccttcagtgatatttcattaactggaggggaaaataaagattagcaagatttagggattcaatgtgctgagagttgattagacaaattttaaaggtcagaaaggtaaaaaccatataatgtagttgtatgcgttggtttcagatatgctacatggcaggtcatgagtgattcctgaatgataagagattccataggatttcagagaagagtcacagtgagctaagagggtggggagatttctttgaagagagttgcagctttcttgggaatgaatttagaggaaagagaatgtgttagtcaattttcacaccgctataaagaactacttgagattgggtaatttatttaaaaaaaaggtttaattgactcacaattcctcatggctagagagacctcaggaaacttacaatcatggtgggaggcaaaggagaagtaagcacctacttcacaaggtggcaggagagagagatagcaaagggggaactgcaacacacttttaaaaccatcagattttgaactcactatcatgagagcggcatgggggatactgcccccatgatccaatcaccccctcaccgggtccctccctcaacacatggtaattacaattcaagatgagatttgagtggggacacagagccaaatcatatcagagaatttaaaagaatttatggaaaaaaacccacatgtttctatgtaggaagcaatacttagttattaagagctctagagtgacaaattttggacaggaatattcactctttccggtagctgacatcacaaacattatcagaccctctgtactgcacttttcttgtatgaaaatgagccagtattagtacctgcctcaaagggctgtttccaggactaaatgagctaatatgtacacatttcttagtgcagtgtctggataagcacctgattattgttgttctattattaaacacatcctgtggaaattattgctcttcttagaaattgggtctagtcttccttattatgtaaagtttattacggagatttttttaatcattaggaatgtgatatgtgggcacatggatggatagatggatggatggatcaatggacaagtggatgaatgaatgaacggatgatagatgtatgatggatagacaaatggatggataggaaactgggtggataagaaacaaagaaaaattccatcaacctgatagtggataataccagataatgttatgctgatttaatccttcctacagcttgtctcagttaatcaaattatatgtcagccacctgttttgtcatattgctgatttattagaacaagtaaattagattcctcataagatttttaaatgattatattaagatttgtatagatgcattacttaaatgcatgctatatctagcttgttcatagttgcaaaatcaaatcaatatattaaagaggcatcttgacatttttgcccaacatgtaagtagctatcttgagtaattttcaagtaattttagttttcattcttcaatcccacagtttgcctcttatagggaatcaatatcccagtcagtgctttatttatttatttatgagaagttaatttattttttattgaattttggattcccatgcttatttgtaaggataatatctataactatttcagactttgctaaagtaccagattgtcatttctggagtcctctgcatccttattctatatggcctgcatgctatttgactggggactgatttttatatagcatgttgatctcacttagattgtataatttaattttagttgtcatgcttttgtcaactttaatttaaattttggatatttgtggagtttaatgttcttattgtgcatgatatagggattgttatataagtactactcttacgggaattatttgggtagactggactaccttttctctgggtctaaagggcatggaaatgtaatttggtctatgtttttcacctttcgtgtaaatgtatcctaaaggaagtttgtctatcatctaagcattaggctaagcatttttgcatgggggttttgtggtgccgtttagtttcatacattctagggtctgagaacaagttcttgtcatagccattgtttctatatttgtctgtagcaaattatctgaaacctttttcattgttgccaatcttccaaaatcaagaggttcttttgcggtattataaagaaaaatgttgcaaagtgtcaagtattatttagtcaaataatagtatgtacaaggctgcctgtggtggctcacgcctataatccaagcactgtggaaggccgaggtgggtggatcatctgagatcaggagtttgagaccagcctgggaaacatggcaaaaccccatctctactaaaaatacagaaaattctctgggcacggtgatgcatgcctgtagccccagctactcaggaggctgacgcagaattccttgaaaccaggaggtggaggttttagtaagccgagatcgtgccattgcactctagcttgggtgacagagtgagactctgtctaaaaaaacccaattatttatttcttgattctcctttttgtttttcctttttatcaagtctcaagtcttcttaattaactttactttcttaatgattttcttgtaatcagtttgttttaaaagaaagccactaacatgtatacaattaaggattttgctcttagtagtctcctctaatactagtttgggattgtgtccactcaatatcaacatctaataataattgtgttcaattataccaggcagtattcaaggtgtattactcagagtaactcacttaatcctcacaaactccaatgagacctttccttgtctcattttacagatttggaaactgaagcacagagagcttcaggaacttgcctataattacacagttaggaaggagtgctctttgacaatttaataattttaacaatgagatgcaattaattcttgtcatagccatttttcattcactaatgtttagaatgaattaatcaaatgtctgacttcataaaacaaaatctgaatgtatgataggattactaacacatatggatgaaaaaaaatcatataccctaaagaatcaccagtatagtcattttctaaagaatgacaaattcactaggtgcacctgacaaataccaatgcagttatcttaaattttgataaactctcttaaatggtagattaaaaaaaaattcttactaaaaacatccccgtaggtatactcagaatatttaagaggaattctgatgtttctgaactgggtgactatttacctgacatatccaaggacacaggcctctctttttttttttttttttttttttggtgaggtggagggggaagaggaggaagttagttactgttgtttcagattcctttgtttacttcaacaaatagagttgtgttattttctctatattttacgtcttcatatcatcacaccattgctcattcattttaatggtagtgaaataatttccctaaattgaaaatatatataccacttgacttactgtgaatgaataaaatgagactgatttaaatgatttatttcatatatctgggttttccattaaatgcaagactacatatatgcttgtgacttcacatggccctgctttgaaatgacacaagctctgtaataaatattgaggatgacagaatccatctcctcatctcattgagaaatcttttaaagaactagaacatgacaaacattattctgaatttcagctctgactcttactagcttctaaccttaaagaagttaggaaatgtacctgaaatctctattagcaaataaaattttaaaataccccgttaaagattcttgaaggatgaaaataatgtttgtaagagctagacacttagtgcatgatacttattgttagcccaatgcagggaggtgccatgaactcttccatatttttaagcacaaatatttttaacttttatcaagatgtgtgacaactcagaatttgagggagtttgatgaagttatttatcattacatggtgtttttaacctcttaagtatttctttattactagctaaatattaaattgatgggttgcaatccagtgctgccaaattctaataatttttatacgtgattccaggtcactatcccaaggtgaaattaaaaaaaaaaaaagatcttttgagccttcctggttccttctgtttcctttggggattatggaattatttcaattttattcaaagattatcactgttttaatgtcaatggggaggaatatattttgttaaaccatcctttatttctcatagtgaacactggacacgttggtgggagttgttctgtgctgagagcatagcaatgaatacagagacagcagacctgccttcacaggttgtatgttctgatgcaagtggcaacaacttgaatgtcaatgaactttagtgctttctttgatgggcaaagggcagagctataaatgctatcacctttttttcctttatatttggaaacatcccatggcccacaaaacattcctcaagtttgtctttgggtagagtgaattcagctttttgcacatttagaagccacattaaatatgtctgtggcaaaaagtttggtgaagttggcaagagatgagtaattattttcacacacatgttaatttcaattttaaaaagtgttttatttctttaaatttaaaaaaaatgagcacttacaccacatgagcacattggctttttttgtggacgttgcctgcatcttctttcctgtttttctatcttcatgaagtcaagtgcaactgaggtggtttattttactacttgcatgtcaatggaatgtggatatcggggctgttgtatgttctggatggaaatgtggtcctgctgcaatacaataaatctcatcattaccctatgtgaccacaaaaagggtgaaccagaaaaatgctaggaagtatggagtcttcataatactaatcacttacatttgtacaaacttaaaaatttcagaggttagatattggctgtaatttccaaaggctctgaggttaggaattcaggtttttaaattcactggagagttaggccttgttttaaaatgtagttttattattcagatgtagtgaggctgacagatcaggagattactgccattgaaaagacagtttgttactcacagttccctagaagaggtgcctgctatgccatgggggtcacatgggggagcacttgggtgagtctggagacagagacaaaaggggagctgtgggcaagagtctttattgtggtttgtctgtgaaggaatgggtgaggcaaagtaaatgggtttaggatggactagattgagtaatttcattgggttttgagacagcagctgcagctgtccctacttgtctggtacctcatcctggggtaactagggaaagtaaatggtgtcccagagcataaaagcccagtaaggaatatggttggaatgtgggctctggatttgttggtttgcaaatggaaggctgcacactcacagctgaatcctacttctaagagttggtgaaaactagaaagagaagggaagtccctactgtgttagcaaagccctggatatgaaagcattagaataaaaggacacatttaacacaggcccaggcactttattcaataaatatttgttaaatgaatcaataaataacggatttgcaaatctttatactgtagtcttgctagtgtttaatcttcatagaaacagtactattctttgagtgacagagtgataaaaagtttattaaatgtgtagaagactgcaaagattaagaaggatatcttaaaaaatagcaactggcaaaatagcacctcgtcatagacttttatttgcatttgaatttctgaaattcaattctctgtgaaagatttgcttgacaactttctttaattattgattcctcctttattttgtaaaactttcttttcattaaatctataacctccagaatggggatagagagatagatagatagatagatagatagatagatagatagatagagatatatatgtatgtgcacatatatacatatatatatacatatatatggctctctgtgacagtaactatctggaaaagtaggaaaaagtactgtgtttaaaattttttaaactaacacataataattttacatatctgtgggatacatagtgatgtggtgatgcatataattacggtaatgagatcagaataattagcatgttgtgcttttttaaaatggcaattttatataattgtataaaacttcacatatatttaacatttttcctgggggaaataataaaggaatatataagcataatcatgggctcagggattttataaatacccatgttaagggaggacttggaacctgaaaagtttacattggagaaaacattgcagaatggcagagtgaagatcttggttaactcagttttcctctaactcaatgttaatgtgaaacatcaaaaatacaacaagacaactaaataacccatttttgatctcagaaaaataaccaaagccacagaatgtactgaggagaacctattcaaaagaaagtactaaactacagtatgacagcaggcccggtgatgttttaagttggtgctatccccatcctttccaccacacacagcagctcagtggcacagtagccaaaggctaagagcattgcagacagcagacagatgtgaccatttttggagcttcactaaaaatactatccccagagcacagtcaatattttgtccaaatctgtagctccctgtgaaatctctgagtgtgttagctatttgatttgacccacagctcaactcaggcaggacaaatacaaaatgtgcaccccacattattacagaaacaatagaaaactgctgataacattttagtcacctagggctgtgattttagttgggaaaacggagcctggctgagaatttaaaaggaaattctaagatctacacaatgataaggactaccaaaaagctctgaaatactcttgggtatctaaactgatgcaaagccatgtgcatgactaagaaagatcttagaagaagccaccagctactcactgaccttacggtcctccctaagcaggaagtgaaggctagtctgtcttgtaatacgctgcctgaagttggaagacatggactcacatacagatccccacggcaaaggatagaggatctataggcaagcaatgtagggaaaacttctaaacaatagttatacactaaattataatgtttaaggtgtgactcctaggaaagcagactttaaaatagtaaaaagaactttaaaaaaatgtcagaagagatctcagtggccacacacagcaggaaatacgtaatctatagaattattccagtaaagcttctaaacaaataaggaatataaaagaaaaaacagctacaagacacgttaaggggaaaggtatggaagaaattatattatctaaattgtccagttttcaacaaaaactcatgagcatgcaaagaagtagaaaagtataccacatgcacagaaaaaaaaaaagccaacaaaaaatgtcctacagaagcccagattttgaatttagtaggggaacaatttaagtcagtgaacctacatgcatacaaaactgagggaaaccatgttgaaataattaaagcaaaatataaaaacaatgtctcacacaacagagaatatcaagaaagagatcaaaataataattttggaaagatcacagaaattttggtgatgtaaagcaaaatatttggaataagaaatccaccagaggatttaaacaacagatttgaataggaggaagagagaatcaggtaacttgatgataggtcaatagagattatgtagtttcagaaagagagtggaaaaacaatgaagaaacatgaacaaagcctcagagaaaagtgagacactatcaagcataataggtgtatacagacattcacagaaggagaagagaaagagaaacagacaaattatttgaggaaataatggctaacaattttccaaatttgtgtaaaaaaatgttaatgtacacattcaagatactcaacaatctccaagtagaataagctcaaagagatccagccctagacacatcaaaagtgacttacgcacaagggagccttaatatcagtttagtgcaaaagtaattgtggtttcagatggtgaattttaaattactataactaggctcaaacacatctttattaatcaaaataggaaccattacaatcaacacattgttgccaatgacaagtcagtttgtttattcctgtagcataaaaatctgtgctttggaatttgatgaactcttggaaaacattctctgcaaaaaaatggttgggctgcttgaagaagttgtagtcggttggcaagaggtcaggtgaatatggcagatgaagcaaaacttcatagcctaattcattcaacttttgaagcattggttgtgcgacatgcagttgggtgttgttgtggagaagaattgggccctttctgttgatgaatgtcagctgcaggccttgcagttttcagtgcatcacattgatttgctgggcatactactcagatgtaatggtttcacagggattcagaaagctgtagtggatcagaccgtcagcagactaccaaacagtgaccatgatcttcttttcgtgcaagtttggccttggggagtgctttgaagcttcttctcaatgcaaccactgagctggtagtcaccagttttcatataaaatccacttttcatcacatgtcacaatctgatagagaaatggtttgttgttgttgcatagaataagacaagatgccatttcaaaatgatattttttaaaatttttcactcagctcatgaggcacccacttatcaagctttttcacctttccaatttgcttcaaatgccaaaggaccatagagtggtcaacgttgagttccttggcaacttcttgtatagttgtaaggggacaacttagatgattgctctcatttagtcattgtcaacttctgatggccagccactatgttcatcaccttcaaggctcttgtctcctttgcaaagcttcttgaaccaccactgcactgtatgttcattagcagtttctcagccaaatgcattgttgatgatgcaagttgtctctcctgatttataacccattttgaacttgaataagaaaattgcttgaatttgctttttgtctaacataatttctgtagtctaaaataaacataaaataaacagaaagtaataagtcattagcaaaataacataaagtgagaaatgtccattaaaatgatgtataacaaaccacatttatttaagaatgtattccaatatcaaacagcaaattccaccaatacaaaaaaaatgcaatgagtttgcaccaactaataagactaacaactgacttcacgtcagaaaccaaggaagctggaaagcagtgagatgacatagttaaagttgtggcagaaaagggctgtcaactgagaactccatctacctcaactcatattcaacaacaaaaagaaaattaaacattccagaaaacaaaaactgagagactaatacaattaatattaaagtgaatctttcaaactgaaatgcaaggacagtatatggtttctcaaatacaaactaagaaataaagaacaccaggaaatgttactacattgtccttaggtcaatatctttctgtttgttactcatttcttgttctatctcttttaaatacaattgtataagcaataattataaaattatttgatagcttaacaaaaaatatagaaagagaaaaagggaattttaaaactatgttagaaaataatctatttaacaatcacaaaagacaggaatggatgaataaagaaatttttaaaaataaggcacatagaaaacaaatagcaaataacagatgcaaatcctacttcatctgtaaataaactaaattgaataattaaacatcccaaattgaaggtggatattgaaagaatggataaaaaataaatatgatccaataatatgctgtttacaaggacacatttttcatggaaagacacaaataagttgaaaataaacaaatggaaaagatatacaaggcaagattgaatcaagatggagatggaatagcaatatcaggcaacatagactttaagataaaatgttataagagtcaaaaaaagcatacgttataatgatgagtcaaaaaatggaagatatatgattataaacatatatgcacctacaaataaggcctcaaatttaatgaagcaaaaactgacagaattaaagacagagagaaagacagagagaactaaacaatttatttgacgattcaatacccactttcaataatggataaaacatctacgcagaagataaaaaagaaaacagaagacttgaacaacactatgaaaaaaggtctagcagatatctaaataactcagcacttaatcacagcagaatgtagcattttctcaagtgcacatggaacaataaaaaatacaaaaatttgaaagaaattaaatgatttctaaataaatagacagaaaatccatgtccatcaatcataagacttaacattactaagctggcaatataccttgcattaatctacagatcctacataatccctgtaaaaatcctagcaagtgttttgcataaatttttatgatgcttataaaatttgtatggaaagataatgattcagaatagtaaaaacaagcttgaggaagaatatttatggaggtctcacctttcccaatgtcaaaacctattttaagcttcagtaataaagacactgaggtattggcatatggatagaagtatagatcacttcagaagtaagactttacatttacactcaactaatttatgacaacagtgccaagatcattcaatggagagggaaaattcttgttaacaaatgttcctgggacaactggatatgcaaagaatgagttttgacctctacctcacaccttactcaaaaatccacacaaaatggactgtagacatgaatgtaagatctaaagtaataaaactagaaaaagacataagagtaaacgttcttgactatgtgttaggcaatgtttttgctgttgttgtttcgctttttacttatgatatcaaaagcaaaaaagatagataaaatggacattatcaaattaaaaacttgtgtatcaaagagcaccaagaaagtgagaaaacaatgcatagaacataagaatatgttaatacatcatatatatggatctagataaattagataaatgcaaattaaagccacagttttgcttcacactcactaagatggttataaacaaagaaacaaaaaataacaagtgttggccaagatgtggagacattggatcctttgtacattgctgctgaaaactggtgcaagccactgtgaaaacaatttggcagttcctcaaaaaattaaacatagaattgttatatgatccagcaaatctactcctaggtatatacccaagggaaataaaataatatcctagcaaaaatagagatagaaagtagactagaagttgacaaagctgggtctggggaagggtcaaggaaaagaagagaagatgaatgattgctaatacgtgtgggaattattttgtaattgatgagaaaggtcccaaaattctattacaataaaggctgaacaacactgtaaatatactaagatggaagtgaatattttaaatggatggattttatagtatgtgaaatgtgtctcagtaaagctgcagaaaaattttcattgtctttctgatagatttgaagaaaatgatgtaagttcttttacttggtaagacgttcagtcttgagagtggttttcagggacagacttataaacagaaaatacaaacgagtgtgcataggttcctgcaatgtattaaattaccttaagatggataaagaacagtgtattagttgagtgaaatccaaagaagctctttttacacttcccccttgttcttaataaagtctcttagtttatcttgctttctgtatctatctatgaaaaatttatctgaactattaatgcatctgttcatcatacactcatgtgcccattcattcatgtatccatgcatgggttctttcaattcactttaagaacctcttaattcaaagaaagagacctgataaaactgattcatacattctgtgaaaacataaacaaaatcaaataaccccccaaagacacaaggaaatgttaagagtagagagtaatatgataatgaggaaatgactgtaggcatatgagattgaaatacaattgtacaaactagtgtttgcatagctgttgtctatgctgaggtcctgctgggtgtgaaacatcataagcagtgctatcatgcatgtcaagagacataagagtgtcctctaaacagaggtgttattttatcccacttgtcaaactgagaggctgtgaaaatattgtaatctttccaaagttattaagacactaaaacagatggcaatttgacagcagaatccatgaccacttctattgttaacctttagaaaaaaaatcaggaactaattgagccttttgtgccactatactctatcttcagcatgggattccccatttacattgtgtattaaacagcacctggaatggttatttcttactgagcattgacaaatctggaatcctaaaggaaaatgttttgctttgatgtaaagctcttcccctcctcctcttttatcttgtattacttgttttttcatttaattagagaagataacgcttccctcagtacagagtgaataataagcctttactttcttgggattggttttgacatatttacacaaggtcttagatgggagacacagacaaggcttcctacacagctgccaggctgctattcatctctctttaaaatcattggttttaatgcaagcacagccaagccaagtttattaattacctttgtgaatagtaaactttatatgtacaatgcaatcatttaggagataataaagtttcaattgcattctctttgaaatatattttatctgtaaaatattttcttcttataataatgattgtctaattcatttaggcacatcattaatctgcatggattttattgttgtttgattggttttgatacacacacatctttttacaaaggggctatttattggagagcagatggtgaaaatgcatagactacacccctgcatagattgatgatttgtaatctgagaagctatgatagggaggagagtgaaaatgcttttattctcaggttataaatggacgatccaatgcaccttggattttttactttatgtaggacaaaaaggcattatttacttatgtagttgatatgcccatggattctaagaaatctgatgggaaaatgaaaaactccattataaatggattcttcatcctaatctaacattttagatatgggcaatctagagtttctcaaattgcaatctacaggcctgctacctcagaatccttttagccattgatatgactaggggctactcttaatctactgtgatgaatatctttggttgggcagaggaggtggcatttgaaccacagttccaggtattgcttttgcccacaaaagcctgagtactcctaaggtttttctgtgggtgttcaccagagctaatcccactcaataaaactggctctggcaaatttccatgattccagagttgattttcaaatgaaagagctataagttatatctataatcttccaacatgacttcctcaattgtatctacattgtcattgtttctcaccacctttatttgaatcctgtcaattttactcttgtttgttttgctgtctgttgtcacagctggtacagattctagtttatcctttccagatttgaaacttctcttactttctcccactaataccatatatatggtcaatggctcatttcctcaaatccttgttagattataatatttaatttgatgaattcatttctcccatgagttaattaagctaatgaaattttctgtatgtattaactaacatgagaactctgggaactctagtgggtctggagggtcaatcctgtatcatggtgctgatcagttatgtggtttcatgatcacaaataacccttatcaagcatcttctgctggacactgtatgtggggcatggtgccccaagcccaaaatcccagcatgttgggagcccaaagtgggaggatcacttgatccccaagagtttgagaccagcctgggcaacacagggaatccccatctctacagaaaatatcttataaaaattagccaggcatggtggcttgtgcttgtagccccagctaattgcaatactgaggcaggaggcttgcttgagcctgggagattgaggctgctgtgagccaggatcacaccactgcactccagcctgggtgacacagtgagaccctctcaaaaaaaaaataaaaataaaaataaaaataaaaagaagaagaagaagaaaaagaaggaaaaatgcatagttatttctttaaagacatttcattctaaatagcaacacagtaattcaaaaattcagcatacacctaagaatacatcataatgtaaagaacacattggtatagcaagtatatgagaccaagctccatcactttcttgttgtgtcatttttaacaagacatagaatgaatgggattcagaaatgggggaaataacatccctgtgatggagacaataacaatgtctcgagactgctctgtagataaatgagataataatgcctataaatgctgtaatagatatttgtgcaaaatgctttgtgttatgggggtaaaatgatcactgatgccttgagatggagtggagaaggatccagcaaggcttgagaaggcagctagactggagtccgatgctgccagtgaagtaatgtcaacacactagtaggacagatgatggaaagcaagtgctatctaatcctgggattccagggaaagtagaagaggcagattattaaaccaatgagagcttcagatcctccctagcactgataaatttccttgaaggagacctgaaccttggtcaatgtcttaaatttgtaataaattaaattggatgaaagtggatttaattaagtggaatacagtggtagcctagcagtttgtttgttttgttctttcgttcatctgcctgctcaggactgcttactgtctgtgttttcaggaggcactgagctgccagagcatacatggattaggaaatagtgtccatgttgcctctgttcccactgggctcaaacccaaaatgcacagttcttggttaagtgaagggttgagggtgtggaccttgactttttatttaatctcatacagtacacatgttggtttggggcaaagaagtttctggttctccatgttaggagagtgtttcaaaattatcctaataggagttaaatagacaattagagttatttcagtggcaaacaaacaaaaacaaaaacaaaaaatgtacaaacaactaagttagttaatgttttctgtgaatatacgataggaaaactatgtcaacaccagtctgagaaatccggtccccaaggggagatcaacaaggttggcagtggatggatggtgaagtggaagtcctttcaggctctggaagaacagagtttgtttgatatccatcgacagggagcctgtggagagggacagatggaagagacgggaaggaagcagtgcatgttttgagttaaagcggtgatattaacaatcagaattggagtaagctagtattccattacctcatcattttctccagaagagcacattggttacatggcccaagtttggggagactcatagctatggatttgaataaagaggcatgcagagaagagatattttaatcctcatcaagaagggcagatttataaatttaaaagaagtcaactggcacttaaaatggcattattttattgataactttccaatcacagtagaacttattctccttaaggcgatcagtatgaggttcagagggtaaaagctaaagcctgttgtccttaaaaagtttattcatgtatgcaaatatgagtttctgaaaatttcatgccattcctgaaattttagtaggctgctaaggatgattttcttagctttttgacagtaaaacacttgggaacctctttcctggtcttttacaacaaccaccacatctttcaaagactcctgctgccccagtatgaagcaaatgcagtttcccttttttccaatatatttagtaagtcaatcttcactaaaagaaaggaatgaatggcaattataataacaaaaatgtctcaggtttcatgaaatgtaaataatgattgacatgaaacaggagcctccatcaagggtctttgtgcctgaggccttctgaccatcaaccatgagcattgttgtgagtccatagggttttggcctcataaccatgggatttcaggctctgggcccagaatcacatggagagttcactaaaataaaccattgctaggctttactgtcagagtttctgattcagtagctccaggatgggaaccaaatttgattttctagtaagttcccaggtgatggcaatgcagttggttgagggatcatacacagagaacaggtgggataaaaaatgagaatgcccttctttttgccaatgtctactctatatcccaactattaagagaaaccttatcatggaatcagtttggaatttaagtacattctctcaccatacacattgacctgtccatgacttaactctccaggtgattctgatgcacaatcaagtttgagaaccagagttttaggcaaacagaatccagaactacaaaaaggaataattatataacttcagagcaagacggcattagtcacttactaaaggaaacctgcaaaatcatgcagactggatttcttttaggaaacttatttttaaacaaatgaaaataacttatttcatgtcagttgtgtttcattactctcaatacattttctgtccaaaagccagtcaagcagttccctttatcaaagggaaacacgttccaggacttccagtgggtgcctgaaaccttggacactgccaaatgctctacatgccatatttttcccttctacatgtatatctgtgataaagtttaattcataaattaggcacagtcagagattaacaataacaaaatgaaatgattaaaacagtatactataataaaagttagtgaacgttgtctctctctcgagatattttattgtaccgtactcaccctcctcctacttgcgatgatggaagagtatgaaaaagatggctactaagggattagtgggtgggcaagtagtgtagacagcacagatatgctggacaaatgaatgattcatgtcccgtggcaagacggactggatggcatgagatctcatcacgttactcagtatgcatgcaatttaaaattctacaagtcgtttatttctgaaatttcctatttaatattattttacctcaggtaactaaaaccttagcaagtgaaactgtggataagggcaggcaaggggctgaaggctaccagttgtatttactgaaatgtagtcttttacaccttattcttgctaatatttcttcacagcaaacaccctgaaagatatacaaaaccaagaaaatacttctaaaataaacatttttaaatattataaaaacgttaactctggaacttctctggcacaaaataccatataatttcacatttgaaaagtatatattcattaattttagatatctataataacccactttctcattaatcttaatcttaattcatccaccattctaattattaggtgtattttcctctaccaattttaacatgcattcaattgtgtctgccaaattattaattaacttagaatgttaaattcacccttccaaaaattaatggaagctaagaagtctagtactatgagatgatgtgatagccaccaggcaaaaagtatattttctttttataattatactcagagacatataataaatcaaagagaagagctaataaatgagaacatttgaagaagatagatagggaaagaaatggccatggtaactcctgtagttggaaaacctatgtcggtatttttaagcctttcgatggcaattcaagatttcaaatgttgaggaaaatctcatatttttataaacatttctgtctcagaaaaaagtgtggatatctcagtaaggtaaaaacagtagaaccactctgaaactattattttactttgttattgctttagaaaataactttcctaattgatacattgtaactcttttcttctctcatggttatgtgttggtatgcagaatgcatcctactgattgtagtgaagaaaatacttctgtttctcacattgataaaatgctagactatggttacataaatgagcttgcatgcagccagcaatcctccctggagctctgtatttaggtctgtggcccagattttcttaaacttttaggctgctatatatttagagtagaatacaaatgagtttcagaggaacataaattatctaaaattgttccatactgcaaaacgttcaaatgtttgtctataaagattttctttgatcacttgtatgccattttcaatcaacacgcattctgtttatgtataaaagctatattgttaccaagctcagtttctagattgagtccatgtataccttgccaataatgattttactgtatttgtatggtttttaaaaatgtctttagaaatgtgcagagggtagtggttgactatttagttcagggttcttgttctgaaaaatctttgctttttgaattctatgttgttttgaactagttaagtgaatgtgcacaagagcctaatgtatttttcctgttctaattgtaatacatgtccagcgagttggctcatttggctaaagggagttgataatgagataagggttgaaggttcaaactccctgttgaccaattaaattcataagagttttccatactcctgtccctaagactaccacatcacaaatacaaaatgttgcacgagagacatttatgagtttaaggatggttcaacagaaacccaaaaccaaccatacatttaaaaatagaccatatttagaactctcaaacagaagggtattaatatcttcattcaaaagttatatttatggcatttgtgtgtacgtgtgtgtgtgtgtgtgtatcctaaaaattatcttgcccccttgaaaggaacaaattttaaataaaaacatcaggaagagatgggttgtagatttttaaatttatagattttgcattgtttaaaacctatattttttcactattaagaaaatgtgttttaagtgttgatggtaaaagaacaattaaacatgtagataagtcaaggtcaaatgcacaagccccaaatgtgcttgcttgacagtgctgcttgttcctgcctctggtttccattccctctgggcaaagcccatgtcactcatttgcaggattgctatgtccttccttctagctggccacccacttctagcctcctttcttttgagtacatcctacacaccattagggattgaccattcgacacattatttctaaccatgttatttctgtgtttaaaacaagcaaaagtgggggtgaaagcgggtgctttgatggtcaaagggggaattaagttcatttttagagcaaaatgtagcattacctctcaaggctgcttgctctctatgcctcactgtttgcccaaggttttgttatatttctctggccttggcttctctgatctctcatcagctggtaaccaggtgttgttgacaccagccttatccagacacgtcctatgccattttggtgtccatctgtactgcgttgaacaatgtcttccaaaaatctctgtctacccagaacatcagaatgtaaggatatttgggtaaagggtctttgtagacatagttaagatgagattatatggattagggtggctcctatggacctgtggagacagacatacagaggaagggtgccatatgacgacagaggcagaaacaggagtgatgctgctgccagccaggggctgctgaccacaggaagctagaaaaggcaagggggcattcttcgttaggagagcataggcctgctgatgccttgattctagacttttagccttccttactgtggaagaataactttctgtcattttaatctactcagtttgtggaactttgtaccaacacccaaggacactaatgcttcatccaacacaattcattgtaaatagcacctgttcagactatataagaagtacattgatttttgttcaccttctctactctctcaattcatcccatcccttaaatgattaatcatttttaatcttttcattttggactaactcacagaaagctgcagaaatagtacagaatatccagcatacccttcacccaatttttcccagtggttacattttagagtacaaaaagtaggaaactgacattgttacattgtgtgtgtgtagttctatgtcacattaccacatgttcttgaaaccaccactggcatcaatatatgggactattccattactaacaaagagtgtatatacacagtcacacccacccacataccctagcaaccactaatgtgttctccatctctataattctgtcattccaagaatgttgtatgaatggaatcatacagaatgtgacttttgaggttgactttccatattcagcttaatgaccttgagatggtaaaaactattgtgcatatcaatattcagtttgtttttatttttgagtaatatttcatggtatggatggttaaacagtctgtttaaccactgtttttttcccaaatatattagtttacaggttttggttattgaaaataaagctattatgaataattgtgtatagatatttgtgtggacatgtttccatttccatgaaataaatggccagctgtgccattgctaggtgatatggccgttgcaggtgtatctttaaaaaaaaactgccaatgtattttcagactgaatgcaccgttttactcctctaccaacaacgtttaagagatacagttttgggaggggggagggatagcattgggagatatacctaatgctagatgacgagttagtgggtgcagcgcaccagcatggcacatgtatacatatgtaattaacctgcatattgtgcacatgtaccctaaaacttaaagtataaaaaaaaagagatatagtttttctaacttattgccagaatttaacattttcaatatatttttaattgtttagctcttccaatacattgcgtcataagattccattattgtcttaatttgtatttccctaatggctagagatgtcaagcaacatttttgtgtgcttattttccatctgtatattctcttcataaaatgtcagatcatgtcttttgtccattttcaaattggatattttggtttttaatgttgagttttaataattctttatgtgttgtaggtacaaacactgtggcagatataagatttgaatttttttccaaatcttttgtttgtattttcatcttattaacaagatttattgaaaaaaaaagatggagtccatttttcaatgtttttcttgtgttgtgcatgtggtttcatatctaagaagtctttttacatttgttttatatttttaattattataggctcataataggtgtataaatttacagggttacatgtgatgttttgatacaggcatacaatgtgtaataatctcaatgggtaataatcacagtggagtatccatcacttcaaacatttatcatttctttgtgttagaatcatttcaattccatcctctttgttattttaaaatatgcaactaattattatcaactaaagtcactctgctgtgctattagatactagatcttactcattctatctaactgtatttttgcatacattaaccatccccacattatcctccacctccccacttctcttcctgccctctggtaaccatcattctattctttatgttcatgagttcaactgttttaattttcagctcccacatatgagtgagaacatgtgaaacttgtctttctgtgccttgctcatttcacctaacataacatctagttccctacatgttgcaaatgacatgattccattcttttattatggctgaatatgactccattgtgtatatgtaccacatttcctttattcattagtctgttgatggaaacttaggttgattccagatcttgactattgtcaatagtgctgcaataaacacaggagcgtagatatctctatgatatgctgatttttttcttttgtgtatatacccagcagtgggattgctggctcatatggtagttctatgttccattttctgaggaatctccaaactattctccatagtggctgtactaatctacattcccatcaacagtgtatgagggttccccattcttgacatcctcaccagcattttttattgcttaccgtttagataaaagccatttttactggtgtgagatgatatctcactgtagttttcttttgcatttctctaataaccaatgatgttgaacaatttttcatatatctgctggccagttgtatgtcttcttttgagaaatgtctattcacatcttttgcccaatttttaactggattatttgatttttttgtctgatagagttttttgagctccgtatatattctactagtctcttgttagatgcatagtttgcaaatattttgtcccattctgtaggttgtctcttcactttattgtttcctttgttggcagaagctttttagctttatgtgatcctatttgtccatttttgccttggtcgctgtgcttttgaggtattactctctaagaactctatacctagctataggtcccaaagatttcctgtgttttattccaaaataatgtatagttgaaaattttacattttaatttataatccattttgagtggttttttaatatatggtataaggtttaattataaatttatatttttgtctatggatagccaattgttctaacaccatttatggaacagactatcatttctccacttattattgtttttcctctcttgctaggcattagatgtcagtacttatgtgtgtctatttcaagattccccattttgtttcattgatctattgtcaatgcctccaccaacaccacaaaatcctgattagtgcataatatttttttaattgaatgaaatgttttcttccaccttattcttcttttcaaaattgctttagctattcttaaatcattgcctgtccatatatattttagaataattctgattatatctactaaaaatgtggtaggattttggtaagaattatgttaaacctgtatacacatttgtagagaattgacatatttactatgttgagtattctaatccatggatgtggcattttttaatttagttcttatttgattttggtgtcagcagtcctttatgatttcaacatgaaactcttatagaattttattagatgtatacttaaatattattttactcattgtaatattatactttaaatttctacttccatgtgcttcttactaatacatataaatacaattgagtttttttcttacagattttttaattatacagttgatttttgtgtgttgatcttgttggattctgtgatcattttaggtccttaagcatacaattctcagggttatttctatagatcaccatgtcatctacaaataagttctattttattttttctttccagatttgtatgtcttttatttccattacttgccttactggactgtctataacttgcagtattatgttgaaaagtagttgtaagagtggatatccttgccttggtctaaagcttaaggggaaaacatttagtcttttaccatatgaactgtatgttttcgtagattctctttatcacattgagaaagttttctctcaattcctagtttaccaaagtttttattatgaatggtgctgaattttggcaaatacttttttccacataaatgtatatgattatttgatattccttctttaggttgtgaagttgtatatcatatagatttgttttcaaatgttaaactagacttgcgacactagaataaactacccttggatgtagtgtataattccctttatgtattggtaaatcctttacattaatattttgttaacaattttttatctatatttatgaataatattgtccgaagtttgtatgtactttcttcggttttggtacaagagtaatactggctgtatacaatgaatagggaagtgttgctgcctccattttctagaaaagaatgtgtagaatttacgtcttatacaattccccaataaaccactaagcttatagatttcatttttgagaaggttttaattataaatttaatttccttaacagttgtgaggttaaagttatctttttcatttcagttgaattttgttagtgtacttttccaagaatgtatccattttgtctagtttataaaatttgtgtgtagagttgtttatagtaattctttttatccttttgatggctatggtgactgtagtgatgttccttccttcatttctattttttagtaaattgtatcttctcaattcgttttttctttttcagtcttgctacagatgtgtccattctattgatatttctggaagaatcaacttttgttttattgcttttttcttttctttctattcttcaattcattattttatgcttattattgtttatttcttttttctttacttgggagttaattttgctcttttattctaattttttgagatggcagattagatttttagtttgaaatttttctttttcttttaatataaacatttagagtgctatagtttagaaaacagcactcatggtctaaagttttctgtcttgctaggctgctttttttgtggttctttggctagaaagtgcaaatttctctagggaccattgttgcttttgtttttgtttgtctgcacccgtaggcatttccaagtcactgacttctccagtaaccaatgttccagtcgtgcccaggcccatagctgctctgctgtcttctttccagtttgctgtgtcttcttagtttgtttcgtagatacaatgtcgacacttttcagttgtactttgaagacaatagagaagtaactctccttcacttccaggaagcagaagtcaaaatttggctaatcttttaacactatacatatattttttttcatgttgctcacctgctaaaagtcccaggaaccatcaaattagccaattagctaaaggatataatcaaattttttatcctggtttctaaactcacaataatctggtcccatccccaataatcatgcatcagatttgtccattcttctttagataactactcaaaatttcctacatagacattttattggacctcattttcctctttcagttttttttttaaatcttgggtttgttttagaaaacaaaataagatgttatagataatactgctttgaaaactgccttgcacagtgctaaggaactatgcaataaaaagtgtttttttttttttgagacggagtttcgctcttgttgcccgggttggagtgcaatggtgcaatggcactatgtcagctcaccacaacctctgcctcctgagttcaagcgattctcctgcctcagcctcctgagtagctgggattacaggcatgcgccaccacacctggctaaattttgtacttttactagagacggggtttctccatgttggtcaggctggtctcgaactcgcaacctcaggtgatctgcctgccttggcctccgaaagttctgggattacaggggtgagccactgcgcccagccaatttattattcttaataataataattgatatatacctaatgtctttgtattagtttgctagggctgccataacaaacaccacggactgagcagattaaacaatggaaatttattttctctcacttctggaggctacaaatccaagactaaggtagcaggatggatttcctctgaagcctttcttcttggattgtagatggctgctttctccctgtattctcatgtgattttttttctctgtgaatgtagctccctggtatctctgtgtgtcctagtgtcatcttattattgtaagaacgccagtcagattgaattaggaccacaacaacgacctcattttaactccatcacctttttaatggccccatcttcaatacagccacattctgaggtattgggggttagggatttaacatataaattgcagggtaagacttatttcataaatgttcctattatttggaataagaaggtgttctgtaatctcttgaactgatttgttaaaagtcacagatgggaaaagataagcagtaagagaagagattgtacttttagcagtcactcttctgattgtgatacaaagattatttaattaattgcttttttgatggcagaaggtcacaactcaatgaaaaagaaggtagcagaaatgaaatattttcttctaactgttaagtagctaacataaaagtctggaacaatcaggcacatttctctcaggatctggactttggaaaaaatgagggtgctcttccttctcaatccaaataaattcagcaattggatcatcaaattttttgccagaatggttacaaagcattagaagaaagctttaaaacatgcaagaaggataatacaaatcacactcctatattcattttattgaaagaaataagagatgatgcaacattggtgaaacttttcttagacttgttaactggtgtagttagaaaacaagcaaggttgtctgagctcctagaaatgctaattgttttcactgtttaagaagtttatatacaaggctaatgccagcatttaaaaatcaaagctaattcctttgtttgaaattcctacagcagtgagagcagaggttgctcaccagggtgggattggggtgggggagtctcagctttcacttggtgtgagcccctgccccaaacctgggatttcatgtcaacctggagagtctagtgcaagggtgtccaatattttggcttccctgggccacactggagaaagaattgtcttgggccacacataaaatacactaacactaatgacagctgatgagctaaagaaaaaaatcacaaaattatctcataatttttaaataaagtttacaaatttgtgttgggctacattgaaagctgtcctgggccacatgcagcctgtgggccacaggtttgagaagcttcgtctagtgttttagcaattcacctcattttctgaaagcagtatttgttagtcctggattgtcatgatgcagattgagaccaattacccaccagtgcctagcactcctcaacccaatttccagcagcgggatgaacagaggttccttgcacagaacaatctgcactccaagttgtctttctggctgggtgatgccccacatagttcccactagatgtcactttgttctttcctacttagctaatgtgggatttccttctggttggttcttttcttagcatgcagtgcaccaaacttcttcctgaaatcaccctcattggaagcctcactcactcttctaaggaggctgagctttttgcagtgtttcctcctgggtgtctctcttagagttgatggtatttcttgaataaaagaatccaagtgcccccactccatgtctgcacttatctgcgaacaatcttttactcacacatctcacctctgtgggggctccctctgttcttttccaacttctcatgccatgtcctctccaagtcaaagctacttacctctcccctcatctggcttgtgaacactccctgtgtttcaggaagtaaggtttgagcccacatatccttattttctgggtgtacattttttcccagagatggcacatgagcaaaaatgtgaagattttagaaacatagaagtcaaatattttgtgcgttgttaaacttctcaccttagtgtgaaaatgaggactgtgccttcaggaaatgtttcagtgtgtcctctgtggtcagttcaatccaactttcaatcccatttatcagttgagattccaaattcaggcaaagaaaagactccccaaaactcccagcatcacagttcttcgctgaggactaacacagaccatcacgaaggacccagacaagactgtttaaggaacagagagacttgaagagagcatctgggactggaccggaacacacaaatccgacagcatggagggccagatggtgttcctctgaacaagatctgggttaagctctcggacagatgtccaagcacagactgcacctgccatcaccagactgaaggacagcttggtgaaggccaggtttgggttcatttctcagatcatgtgagaaaaaaagcaagggaaaatataggccataaggaatcaatcctgcaaaattaaaaaaaaattggtctctttatgcatcactttctcttcacaactccatttgggatggtttaggatggtcgaaattggtgtaaaatgtgcaactataagaatataaattaattagacttgtttcatgtgaatgcacaagaatatgcattgaatgtgtttcatttcacagataggctttgacatacattatctctcttaaacacacacaaaaaaagctacaaaacagttcaacaccattttattgataagaaaatgacaactatgacgtctctatgcagctcctgcatagtctttctgttctttaatgtactgtgcccagtgtcaaccacaattctgggtatgctctcttttctctgcttaaaacatattatctttcccacccaactttcactcagttcctgcttggttattcactaagcttcagcatagatagccttcttccaggaagccaccacagtctggaataagttatcctcagaaatagtttttctatcatcatgcttactgcactctatcatcccagctgttttcttgttcatctcctcactagacgagacctcctgatggacaggcagaaagtctcattgttaaggcattcccagctcttagaacggtgtctagtccatgtaaacagacaataatacgtgtcaaatgaatgggtggcatagctgaagatttattatgtataaatgtatatttatttcttatgcataaacaggctaaaaaccaaactcctcttcttcggctgaagtaagcattctctgtaagtttagaactatgatttcattttctaagaaatattataccatcttttattttcccttaaattgtattctaacagtaggcattgttcactagctgacactcttttgggattacacacttaagaaatatacaagaccttatgtaagaattaaaaagttaaggttatataatctgcaatctctggaagtgaatgtctctgtaaatttcaataatatgagttcatcatatttaatgcttcttcatttacaccatagatacataactttccaagctcttgcttttcagcactgggtggtccttcctcccttcctaattaagtttgtgtgacaactggcttgcacagtcagtgaatttattctctaagtttagaaaatcataaacattgtatgtattttcacaatttaattagttggcagttttgttaaagtgcagatcattaaaaaatattattttaatgtaggttatcttaaaggttttttgctgagtctatagtaaaccagtgcttctcaacctttatcaggaatgatctgaagattttcttaaaatggtgattcaggtccagcaggtctaacgtggggcctgagattctgcattctaaccagctctgtgagatggccaatgatgccagcctgtgaaccaggacctcaaaataagagttgtcatctggttcactcgtgctccctaatgctgaaaatgaaatttatagtaaggttgctaataaaatgcaatagataatagataaatagttagaaggtaaatgcttcagattattttgttaatgtgaatttaaaattatcctgcttctcctaatatatgttgtgtattttaaaagaagcaatgatgtaacataagttttaaagccagatttgacttctggattgtccctttagtagccagttgtccttggacaaattcattaattatcttgtcaagttacaaacattgggctagttatcaaatctcaggtctcttggtttgaataaaatgggtaaatttatataatagcaataagccagggatatggtaaatacgtaataaatcataattaaagtaataataacaatctccctttagaaactgatgagagagtgtggaagaattactcaatgttagccatgaaagggactttgtgggtgctctaacccaaaccttcctctgacactgaaatcccttctggcatgccatcttgcctgaaaagctgagcctccttgccctcgcttttaattaaatcatcagaaactccttccacactccaactacgatacgctttcctaagacttccacctcagccttgttctttcttatgaattcatacaggaatggctccatcattttgtcctgttctggtcctcctgtgcttgacaattgcccataggtggtctccttgccttctgtacacgtggaaaacaatcactcttttccacccttccctctggctgatctatgtacccctgaaaatagagcatccagacaaaaggcaagaatcgggtggactaatcgtagatgtgtactgcagaatgggctcctccaagtttctggttctgggaactgtagttctcttagtgcaatccaagatcacattggcactgtggtcacatcacagtaaggacccagtggaaattatgactgagtgtcgtcacaagcaactctatcactcctctctccaaccctcctgtgcagtgggtttaagggatgcacagaccttatcactattcctgtcaaaggtattactatattgcattccttttatattactctcatggcaggccacattgatttagatcatttttctttccatcaatgaatttgctgttcctccccatttgatgtgaagggtaaaagaaaaaaaattcatcactctgatttcaaagttcttgtctaagtcatgaataaaaatcctaaaaaggataattctagacacaaaaatcctaatgaccaaaagaagtgtctcccacctgtgagtcagatctactgacacagatataaagacagtgctgatcgcacatttgatgctctcttataatagtgaatgacataccaggactctatggactcttggtttggctcacactgagtaagcagagtgtcttccgtacatttcactttggttaatcaggtgttggtgtgtgtttcacatcagctgatcatgccccatcaggttgcatataagacttcatccgtggtggtgtaccctgcaggagccctttggggaactccgatgacacataaggatgccttgtgcttctcatagcttcccattatccctggtttcagaaattaaaatggggtcgtttgcttaagatggccatagtaggtccttgcatttatcttagtctccacctgggtgtgatgattgtatctgataagtaacttgtggaataagagttcaaattaggctgggcgtggtggctcatgcctgtaatcccagcactttaggaggccgaggagggcagatcacaaggtcaggagatcgagaccatcctggctaacacggtgaaatactgtgtctactaaaaatgcaaaaaagtagcggggcatggtggcgggcgcctgtagtcccagctactcaggaggctgaggcaggagaatggcatgaacctgggaggcggagcttgcagtgagccgagatcgcgccacggcactccagcctgggtgacagagcaagactccgtctcaaaaaaaaaaaaaaaaaaaaaaaaaaaaactcaagttaattcctaggccatgtctttatctaaaatgggtatcagcacaggcgaggcctctcattgggatgcatcaactgatccattttattttaatcagaatcaccatattatcttcctttaatctttccctatacatttctctaattaatgatttacattttttttgcctatagagtatattccctatttcccatatcaaatcttgccattattagattcctctgagtgctttaatggatgtgaattttactagtttgtatgctttcgttttatttctaattggtcaaatcggtgttatattttttctagtaatttgggaggcagaaacttaaacctcagacccgtaagtcatgattcagaagacactgaacttgctaatgattgactgcccggggtgtggagggtgaaggaggcctttgcctgctacggaagctgcacggaccacagccctagtgcacatgatgtcgagctctctgtgtgccttcgaggaaggtgtccaaggggcagtgcacacactgactcttggacgccacagagttgatgaaatgagaactaagatgagtcatgttgaatccaagacttgtgcaatttataaaacagagaagtggacaggcaagctaagagcaggagtttagaacaccactgactaagcacctgaagcccacctgtgctgctctggcggtcgctggttgttggcactgatgtctctgccttgcctgatgattaagaaaacacctcactttttgcttcaggtagaaatatttgcaccacacactaaaacctactgcatttaactccatatctttttataaaaattatatatgtaaaaaaaatttagaaataaatgagacacagactttttgttataaaacttatagcgtgcttattttttctatctcattttgaggcatttgttatctttctttttaagcatttctagtcattgtaagttacttaaactgtatatcttaatttgttagtggccacttggaatgtgtgcaaactacaccattaaaaacttattggagaagagtgacatgattaagccaatgcagggattattaagtattgcaggtaaattcacaagtaagatattctgtaggacaagcaatcctatttcttcaactaataaatggcaagaaagacaaagggaaggagatgcttataaatgtaagacatttaaaaccaaagcaaagaaagacgttatgtgaacctcatttagacctgggtttaaaaaatacattgatgagaaatctatgagaattttaggagaaatttaaaaatgacttgggtattagatggtattaaataatagttattaatttcattagggattttcatgacatttttgttgtttaaaagtgcccttatctgctagagaagcacaaaggggcattttttaaattaattattattattattttttgagacggagttttgctcttgttacccaggctggagtgtaatggcatgatcttggcttactgcaacccccgcctcccaggttcaagtgattctcctgcctcagcctcccaagtaactgggattacaggcatgttccaccatgcccggctaattttgtatttttagtagagacagggtttctccatgttgcccagtctggtctcgagctcccgacctcagatgatccatctgcctcggcctcccaaagtgctgggattacaggcgtgagccaccacacctggccaaggagcatttgtagttaaaataaaatagtattattgagtcgctttgaaattcaacaaacaaaagcagaagacatgttcaaatgtcaattgctgttggagatgaatggtgggtacaggcagagtcactacaccattctctcccagttgatgagtttttgaaatttttcataataaaacatatttaataaattaactaaaataacactaataaagactctaaacatttaatgttgcaacattaatgacagtgtaaatcactgtgaagctggagagattattgacaacactaagcattgtattcaatgtaaaaataagtcttgggattaaacggaattgagctcagtagaacttacgattgtaaatattttttttcttctaaatcatcctcttttatccagtttgtacaactttcacaatttataccttcttttattcaggcatcacagctgcaggaaatctgttaagggactgtggaaccatatttgtgtcccagttgaaaagcgacaacatccccttttgattcatgcctctctgttgtggaactagtttctagatgtggtatttcataatcattctaatctagactctatgaattgatctttcctcttaatgagtttgttcaagagcaaaggaaaaatattggttactgttctttcctgtagacatggcctttgctcctagcagaggtggctacaaaattcacagctgcacctggatcccatcctttcatactccacacttttgaatatctctatcttgtcttatatagatgttcctcaacttacaatggggttacatccttataaaaccatcataatttgaaaatgcattcaacaccctgataaaccaattataaagctaaaaaactgtgagtgaaaccgtggtatattggggactgtttgtatttctaaccttttcttctcatttttttggtcatcagcctttatacatgagacaatttactcaatctttgattttctttgctttcaataagcaacaattaaatataattttaccaccatctctctctgggatctgttcccatctcttcattcctacagcaatctatctagtcccctccaccaattcccatccccacagcccacccccagggtgctgctgatgtgttgtaggtcctacccctaatccattcttcacagaggaggttgaagaaacttttaaaaatgcaaatcttaaaataattctcatgaactgaaaacttccgcgggctgggagctcctgtagtctcagctacagttgagactgaggtaggaggaaagctttggcctaggaatttgaggttgcagtgaaccatgatagcatcattgctttccagccagggtgacagacagagacggtctttaaaaaagaaaaagataaagaaaaaaacctggtggaacccattgatgaagtgcagtggtgtgatcatagctctttgcagcctcaaactcctgggctcaagtgatcctcctagcccagcctctcaagtagctgggactacaggcacatgctgacatgcctggctaattgacttttttttttttttggtagaggtaaggtcttgcattgttccccagactagtctaaattcttggattccagtgttgcccaggctaatctaaattattggattctagtgatcctcccaccttagcctctcaaagcagtgggattatagccatgagctatggctcgttgccaattttaccaataattgtctatttagcaattaaagcaatgtaaagattttggcttgtgtccacacaggcatgagccattgagtaataaaaaactaaaagttatgattttttaaaattatgtgtatttaaatttatgattactagttttatttatttcccttcctttcttcccttccctctgttattttccttctactctgaaagaatgaagataacacaattttatgcactttctcaaactttaagatgcaaaataatcatttagggagaacatgtaaaaatacaaattttctttatcagtagagaatctatattagcgagtctatattagcaagtctaaattgaagccaggaatatgactttttataagtaaagcaaatgattttgatagatgatgtccacatacagagaacccaaatgcttctggaattatttcttgcatagcaggaaattaaattaggattttttgactaaggcacaaatgtatgctatatatggcataccagcaggaacaagatgaaaattttaaaaagaagtaactggaaaccatttacatgacctttcattccttattcacattgaatttatgaaagcagtctgctttataaaataatttgtgaaggggatgtctttgcacagagttgcaggagtaaactgtgagttccttcacactcctggcctcacactcttgaagctgactatgcgttcctgcaattaagggacccagtggacagatgtttgactcgcacccaggccatccagaagttgagagagtgggtggctccagctttaacagtaaaattaaagatgctttggtattcaacagtattcctaatttgtcagaaagtgttgcttgtggaacagtgagattacaacatagggagataagcactcttgtgcgtgcacacacatacacacacacaccaaaaacagcaatgtaggctgaggtgggaaactgccacctgaggaaaatgcattacgcatgtcatagcagcctagggagatgtccttagtgaggacatttaagaaccaacagaaaatcaagaagctttaaacatctctctggtttagggaaaaataaatcatctatgataacactaatcacataaaactttattatcattctgacatctctctgaatagtcacctttatgtaatactaaaaaaaatttctgaaaaactacaagttgcaaagaagagaagggccatatccccctctttttcgccaggggttaaactcacagaagtccctagttatggaagaaagaagatacaattttaagcaagttaaatgctttgaatgtaacataagtcagacatattttaccagtaagttaagaatgtgtttctaagttgccatcacattttttaaccaagaattatcagataagtaaggggacgaccaacctttttacctaagagcaggagagaaatttacattttagagggaatcacaagacctgcttgtaagaatcctgagtgtcttttaaatttctttcttttgggccaaaattaaaccggatttcaaaagcacattaaaataacatagttgtgatattaatgtcttctaatggtgaaattagcttaaaaatggcttttcatttgatcattctctactggggcatatgagggtcaccattactttgaacatgatattttgtgtccttacttcaggaggtgtggcatggagcctagaacctggacttcttaatcgctctgtaaaataatctggaataaactctgcaagagaactataggttcatataaaggtctaaagctatagccttggaatttcttcttgttttctcataaaataacatctataaactgctgtatataaaatttgtaacagaattaccacattgtttcatcatatttgccattgaaaacttttgatctcacaaggacagaaaaatgtattgattcttcaagaacttccagatataaggacttaagagatgattttatggttataaggaaattttcaatttgttcagtgaattaaaatagatgatatttgcgaaccatttaaaatagtgtctaaaatataggaaggactctgttggtttagatagatagatgatagctagatagataaagagattgagacagactgagagagcaagtctacatgatgtagagccttttcctatggcagtggtgagaaacagctcccagtgttaggagacagtagggtgcagggccagagcacatgtgctggaagtcagaaaacgtgggttgacatccgagcccagtcccttaactcgcttggtgtattaggctgttctttgccttactataaagaaatacttgtggctgggtaatatatataaagaaaggaggtttaattggctcattttttctgcaggttgtacaagcatggctccagcatctgcttctagtgagagcctcaggaaacttacaatcatggcagaaagtagagcatgagcaggcacatcacgtgctcagagtagcagcaagagccagaaggaaagatgcaacacatttttaaacaaccaatctcatgaagacttagacattattgtgaggacagctaagccattaatgacaatttcacccccatgatccaatcacctcccaccagaccgcatctccaacattggagattacaattcaacataagatttaggggggacaacatctaaactttattacttaggatttacttcttttggggagggggtcctcagtttcttcatttctaaatcagagataataaaaactatcaaaaatatgtgttgttgtaatcaaaatagtaaaccaacataccccacaaaaatgattacatatagtaagacaaatagtgggtaattttctaactttcaaactcttctagcaccagatcctatggatatgtgattctgttaggataaaagagacacaaagatgtagtgtattcagcccatctgggttctgattttagttctgttgagaacaatttgtaagacattgttcagttgtactggccaccaaagctctaagaacttcctagctgtgtgaagaagctcaacgagatcaggggttagcaaatttttctttaaatggccaaagagtagagttcaggctttgaagagccacagggtgtgtgtagcaaatactcaactccatgattttagtgaggaagcagtcttagacaatacataaacaaattatcttgtgcttgtgatctaataaaattgtatttatgggcactgaaatttgagtttcacatttcaacttgtcattaaataatatccttctttcgacatttttcaacctttaaatatgtaaaggtcattcttagctacaggccataagtaataggtgacagactagatttggtgccaggactggagttttctgatctccaaactagattgtttccaagagctagcatactctcaaaaccttgattctgttgttgtaattggtgctctttgatctattttctcattctcatccccacactcccatttctgcatatctacttggtattctttctgaaaattacctcatggttgcaagctcataatttgtaaagggctgttatcaagaaagataacatattattttaaatatttaaatgtttaactcactatcattcatcaaatggtaagttaattctactcttttttaaatattctgaaatcaagaatcataaccaccccattctagcgtgaatttatattaccaagacttgggccaagagtaatcattcattaacctgaattcaattaaatgaacctaaaacaaaggagttcatagaaaaaacaaagagaatcccagcatttctctgttatttgtatgtgtttgtttatttaaacaaaagaagtgattttcctctgccacaaatgctgactgttcaatttttgcatcttgtcaaattttcccaggtatctgattttttgatatgttatgtcttagcctcctttacttttacctactagaagttgatgtttcttcataaccaaattattagcctttatacaaataagtttttgcattatttacaaatattagttttgttccagttacactttactgttccaaagatatttaaaatgtcatttatgttattaagttagtttctttgagttttctacattccaaaattcttactctccttttcatttttaggagtattaaattttcttagaatatacggtgaaggtctaaaagaaatttatttttaaattccagcactttgggaggctgagtagggcagatcacttgagctcaggagaccaacctggacaacatggtaaaaccccatgtctacaaaaaacacaaatgttagccaggtatggtggtgcatgcctgtggtctcagctgcttgggaggctgaggtgaaaggaatgcttgagcccaggcagtcaatgctgcagtgagccatgatggtgccaccatgctctagccttggtgacacagagatgctgccaaaaaaaaaaatttttagttcaacatacaatcaatcattaatattatcatttacctatatgcagacctacttaacatttataaacttatattttttcatataaaagaaggctctatgtaaaatgtgagagataaaagttagatccaaggaaggactcaaaattaagagatactaggtaatcataaaaagctattttaattacatgaacagaatacattcatgaccagaatgtttcatggaacaaattgatgggggaaatagttgccattttagaaaactttctagttgtaagacttaaacaaaataactgtcattaagtaagtatatgtaataggataaacataaaatgtcctcccagtcaccttctgcaaagtaaggtgaagggaaagcttatcctgtgtttctcaaacttgactgtcataacaacctgggggtgtcacatgctaagttaaatattctccatgccttagagattctagatgaagatgcgccaaagaatctgtattttaccaagttgctaagatgatttttgaaaattatgcaaatttggtgaatcctgagttagtggttaagacttaaggatcaaaattttaagttttttctgctttaaaattcgataatcatactaatttcaaggtatttttcagagtattaaatgagagggcatatggaatggacttatttgagaacctggcacaaataaaacaattaataaatcatccttgcaggtgtaatacattgtaaatacattttttgtgttggcatccatgaaaaaaaataaagtaatttaaatttatttatcagattaaataacttcctttaaacaatcaggcaaatttattaaatcttctgaattttagtttatcctcctcaaaaataaggggttaaagtgggttttaaaaatattgggattgagggaaatttgaattcttgaagataaaccaagagaaaaaaagagaaagaaaaaaataaagtcatgcccagcattcacagtaaaatagttgtatatatgaaataagaaatctgacaacttgtctttacatttactgctgctagccctgaaaaatggcagagtgtggggtgaatgcatgatcctcatgtgcagcattacctgcacctccaaatgtgctccttcactttagtattatctctttgttttctttccatcttttacaatagtcattaacttaaatactttgatttttaattacattctttcattttcagcactatatttatcaaaacatagaaaaggtgtcagctcctaatgaacaaaacaaatattaaatgaaggtgagaaaactctagttttttcacttaatttattagttctgttttgtagaatgtcgctcatattttttaatactaattagtaaattatggcaatatcataaacctattttttatgtgtttgaccttatcattaatattttggctgatttcttaatattttacctctgacctgaaattagtttagcattgatgtgaataatggcagttgccaagtaagttttgcctaataggactggggtttggtttttaattttgtaattctttacattgaaatttgctacctaattttaacagtatgtcatttacgattgatgcaggcaagaactctgttatattaataaatagtgcatcaatattctaaaccactcaaaaaagttaaaaaaactataattggttgctgagagaattaaaaataaaattatataaaatgctcaattaaagctaaagaaggcaggatagagtgaaaacaaaaaaaaagaaaaatggaaaagagccatgaattgtaaagattagcaaatacgctatacattaagtcaactatgtcaataatcactttaatttaaaatgttctaaatacgtcatttaaaagacaggctaacagaatgcgcaaggaaacaagatccaactgcattatctacaagaaacttaccttaaatataaagaaacagatagacaacttgtaaatatatagagaaatatatgccatgttaacactaaccaaaagaaagctaaagtagctaaattatatcaaataggtcattatatataaaggaggtcattattatatttatgcatggattgattcatcagaagtcataatagtcattaacatgtttgcacttaaaaacagacgatctttatttgtgagaggaaaagctgacagaattgttaggataactggatgaattaaccattatatttgagcactcatctcccctccatcagaaacagatagatccagcaggtagaaaatgagtgcatagtggaactaagcagcacctcaatcaactaaatctagttggcacatatagaatactttatccaacaatggcagaatccacaatagactacattcggggccataaagtacatcttaacaaatttaaaataatagaaacatacaaagtataattttagaccatagtgggattaaaatagaaatcaataatagaaagatagctggaaaactctaaaatgcttacaggttaatcaacttttcaataacacatggatcaaaggagaagtctcaggagaaatttaaaaatattttgaatgaaatgaaaatgagaatactataatacatgtcaaaattcgtggaattcagcaaaagcaatgtttagaggaaaatttatagcacagaatgtatatattataaaataaatattgaaatcaacaatctaatctttcaccttaggaaacgagaaaaataagagtaaagaaaatcccaaataaacagaagaaaaaataataaagttaaagcagaaatcaataaaattaaatacaggaaatcaacagaatcagtgaaagcaaaggctggctctttgaaaaaaaatcaataaaatcaaaacacccttagcgagttaattatgtaaaaaagagagaagacacaaattattaatatcagaaatgaaagagaggccatcattattgatctcatggacattcatagagtagtaagggaatattatgaacaagcctgtgcttacaaatttgataacctagacaaaatggaccatcttcttgaaagacatgatctgccaaaactcatacaagcagaaacagagaacctgaataggttctatatctattaatgaaatttaatcaataattaataaccttccaaaacaaaaagcaccaggctagatgtgtttacttgtgtattcttccccaaattcaaggagtaaacagattgaattataagtaaaaacttcccaaataaaatcctaagtacagatgcttaattgataaatacaaccaacagcttattgaagaaataatacaaattcttcacaaaatctttgaaaatacaagaggagggagcacataaaaactcattctatgaggacaatattaccttgctataaaaaccaggcaaatatatcacatgaaaagaaaactacaggtcaacatcccatatcaatgtaaacacacaaatcttcaaagtaatacaaggaatccagaaacttatttatcccagtattgtaaattgtatttatccaggagtgtaatattggaaaataaattaatttaattttccatattaatagaaaaaataaaccttaatataagcataaattatagctgatgaaatccaacccctttcatgataaaaatacccaacaaactaaaagtagaagagaaattcttcaacttgataaaaggcatctatgaaaaatccacatctaattcatccttattggtgaaagattgaatactttccccctaagactgggaacaagacaaggatatgtgctcttgccacttatattaaacattgtaatagaaggtctagccaggttagtacggcaagaaaaagaaataaaacatacttattttggaaagtaaaaaataaaattacaccagaggacattatctttagatagaaaatcttgacacacacacacacacacacacacacacacaaacaaacaagaagaaaacatttaaattaaaaacgtagcaagataacagcatataagatcgaagtttaaatataaattgtattttgtacactagcaatatgcaatccaaataaaattgagaactgttccattgacagcagcataaaaataataaaatgcttatgaataaatttaatgaaaaagtgcaaacatgtatgcattgtttcctagggctgccatattaaagtgccacaaatgaggtggcttaaaataaccaaaatttattgtctcacagttgtgtaagtttgaagtctgaaatgaagttgtcaagagagccatgctctgaaacacatacaaagatccttccttacctcttcctagctgtcagtggtttcccagcaatcttcagcattcctcggcttatagctacgtaactccatcctctgccgttctgccacccagtattcttgtgtgcctctgtcttcacatggctgtcttcctatagaaacaccagtcatattggactaggaagtgaccctacctttaaatatgttcacattcagaagtactagagattaggacttcaacctacttttttgggggcagacataatccaaaccataacaatttgtattctgggaaccacaagatacttttgaacaaaattaaagatgatctaaatttttaaaaatatttcatggtgatggattttaatattgttaagatgtttatacctccaaaactgacctaaagaaacaatgctttccttatcaaaatttcagcttttttgcagaaattgagaatcagatgataaaattcatatgcaagagacctagaataattgaaacaattccaaaaagatagaacaaagttggaggattcatactatatttcctgatttcaaaactgactaaaaggatagagtaatcagataatataatataatctgattactgtaatgtaatataaagatacacatgtaaattaatagagtaaacttgggagtttagaaatacagttttacactaaaattcattgttacaacattttatcaatgtggccaagacaattcattaagtaatagtatttttatccaacggcacaaggacttctggatatccacatgcaaaaagaattaagttggatgcctaatttacaccatataataattaacttaaaatgcattatgcacttaaatggaagagctaaaattacaacactcttataggaaaatgtaagaataaattcttgtgccctaaagttaggcaattgtttcttggctatgccaacaaaatcacaaggaaaaaatttaaaagtagataagttggatttcattaaaattaaaaaagagtttttaccccagtggacactattaatagatcaatttacaaaattagataaactatttgtcaattacatttctaataagggcctagtatccggaaaacataaacatttcttttaactgacagtaaaaagacaacccaaatttaaatatttaaggaattaaagagatatttctccaaaagaagaaacacatatgcaccatatgcaaatgaaagtatgcttaatatcattaatcatcattgaaattaaaatcaaaaccacattgagctatcactttatgtccactaggatggccattgccagaaaacagacagtaataaatgctggcccagatgcagaggaattggaacactcttatattgctggggcatctgaaatggcacagctgccttacaaaacctttgctaataccttaaaatatttagcctagagttctcatgtgacccagtaactccactgccatgataaatgaaaccacgtcccatattcacccaagataaatgaacacacattaacagaaatgcttttacaaaaagggtcatagtggaattacgcaccatagttacaaagtggaaatgatccaaatgaccattaactgatgaatggatgaacaaaatgtggaatgcttttacaagggaatagtctttgtcaataaaaagaaggaaatgcagatacatgctataacatggtgaaacctcattgaaaacatgaaaacattaagctaagtgaaataagtaaaaaagatcacatattgtatgatttcatttatatgtaatgtccagaataagctaacccatagaaatataaatagactggtggtttccagggattagggagaggaatgattagggaatgatatttttctttgtgtaagtaaaatattttaaaagtagacagtagtgatgattttgctatcctggaatataataaacgtcactgaattatagacttcaaaagtgaacttcatggtttacaatgaatgaattatattttgattataaatatgcatatatataaatatatataattgtgtgtgtgtgtgtgtgtgtgtgtgtgtgtgtgtataatccaggatagtatcctggatagaatcctggattgtttaagctgccaaaacttccaaattagtaacacatgaacttgttcaatgactcctctgtcacctcttgaaattaattccagccatttatttatctacaacacaaaccccaccacaacacatacacattgtgagctaaacttcatttttctgatgacttctctcatattctaaatccatatttcctttttcaagcaatttttgaaacaccaaaactattgattgagctcccatcaggtggagaacaagatacttctcattactagcagggactgtgtcaggcatctcaagcaatccagaaaaatttatgcatcatattcctgcctgtaagaagtggcatttaaattctggctttgatcctcttacttactataatattgattctcaataaagaagacaaagttactatcacccttatgtgaatattcccaaatctccaatttcagcattgggtctctgatgagttgatgattattatttaatggactccaactgtgacaacacgactcatctttcccaaatgggctcccttctgggcagctcccttctcagcaaatgatgtcatcatttacccacttgcccttgccagaaacctgggcattgtttgtaaatgtttcttctcacttacttatattctatattcaaccaatcaccaagttctatgtactttaccttctaaagagattttacttctctccaattatctccttacccactacttatttccttaaccattacttatctccttatctgttactgctatccttggccaaggtatcatcttttcatacttatattactgaacaaaccataaactctttccatctttgttccatatcatttttcatactgttgccaaaatgttccttctcatgagagcatttctcagtggcttccattgttcaaggtaaggtatacaatttttaacctggtgatcgaataacctgctccttgcctactgttccagcctcagttcttattatttatttatttttgagttggggttttactccgttccccaagctagagtgcagtggtgcaatcatggctcaccgcaaccttgaactcttgggtccaagccattttctgacctcagcctctagagaaactaagaatccaggtgtgcaccaccatgcccagctaatttcttattgttatttattgtagaaatggggtcttgctatgttgctcaggctagtctcaaactgctgggctcaagtgttcctctgacctcggcctctcaaggtacatcccaccttggcctctcaaggcataagccagtgaactaggccttcaattttttttaaacttctctcactcatatggctgaaccaccctgccctttcttaaattcttcaaatggactgcaattgtctcatcattccgacttgcctgtaattcagactcactctttcccacactaacctcaactgcttcaatggctccacctagctaacatctgctgaatgttcggaactcactaagctgatactgcttctaggactttttccctgatcacccccaagttggtgagagaatacttggtattaacctcccttaagactttatagtatttatatgttccattttctctactcctgtatacattgctacctctgggaaagcaagaagcactcccattttattatatcttgctttgaaaaaaatccggtgatcagtaaatatttttgaatgaagaaatatgatttgaaaggtgtttaccaggttttcaatgaactttaaaaaacatgttaatgctcctgtttctttaaattgaagaagtccctctcatgaggctccatggtgctggaatgcgtggggcagggaggaaaacagatgtcttcttattcctgtgtgggcgagtttattaacatccctgaatctcaatttcctcatttgtaaaaggcattagaacacatgaggactgtttgtgggtaaaaagaaatgttgtctgtaaagcatgccaattgaggaagcagcgcttgtctttcccatcttttctcagtacctctcccctcgccagtcagtcctgagaaaaggtacctcgaagttggtcctaactcataacccattctttttttctctcattagaaaacaagtcatttgcattacttctaagcaagagttggaaaaacaaacacattaatgtattttataattttaaaaaattgtttgatagacttaataggccctgtttttcttaagaaaatatatgttgctgtctttttattggaaacaatggataatgtaccaggccaggtaattctatttgaccccatttttctatcctttctgttttgaagggcttggaagcagttccaaacggagggaaaaatgaatcatcacctttccgtacatgcattttggattgtcagattggatttgaaaatagcctcatattgtttcactccacaatagataaaacatgaatttctatcagcctcatgaccttcttgtttccccggtactcctgctttaatctaaggattctctgttcttgagcttgcatagttgagttagagcaaattaatgaaagacaatatgtcctactatgttccacagataaaataccaggatcatccataaaggtcaaaactgagtgagcccagaggagattttggacctaggattggccttaggcactttgtctgaaagagaagagcctgaaccttactcaaggctacaatatcttcctcctccgattgctatggaaacatttcttttattttttaaagcaaacatccatgccagacatatgacacagcagaaaagctgtggagaaggatgaagtcaggagtttggaatcatctttcaagatatatagcccagtggttaaattttcaggccctggagtgtgtccaacttcttgggttccaatctgttcacaaaccacacaaagcaggtttcttaatcacttcatgcaagcagtcacatcattagtaaagtaagaaagatgacgacatttccttcctgtggtgccgtgtggtttactgtatgtaaagtcttttagaacattgtctggtgcaaagcaccatcagtgttagctgtaattatcaagtttcagcttccaacaatgtcaagcaagatagatgagtgaataggccccatggaggcaattggggattgctggaacagcaggacactgggctgcatttgttaggatcaagggcaggcatgttttatttcaaaataaacaagcaagccagcaaatcctcactgagcctccaggtttaggtttatagagtgtaaccatgtcatctaccctgtgttttgagatttaacttataatttattatatcaaacctaagtatattgttgcaagagataagacaatgagtcatatttcatcatgcacttctttagtgattcagcaaaacacaatttcgaggaaatatttaaaattgttatagttactaagaaataaattacgtggacagcctctctctatcatttctttcatttttaagggaagaattgttttactcagaacgtggtgttctcctagccagagaaacagtcagtttgtcatatgcgttcatcttttgtcatatttgttaaagggctatgctgagtggaaatgcagctgcacaggtaacttaagctcacaggtggaagccagatgcatgaagacacaatgggttagggtgattataccttatcgggagcaatgccttggctgagcctgtacattcttttttttcttctttagaagctttacacttttttgtttttgtttttcatctttctaactttatttgaaatgccacagtggagcagaaagtgtgtaggctgtaaaatgaaagagaacaaggtcaaagtcaaatccaagatctggtactaacctgggaaaattacataatctccccaagcactggtgtcaaaatctgtaaaatggaggtgatatgtcatggttaaggactgctttaaggattaaattcataagatatatagtaaggcctatagcactatgtacacagaatgaagtgtcatcggaagcttcttcctcctctgtctttagagtctacaagacctgcaacctgggactgtgtccatccctgtttgagttgctcaacaggacttggttaggccctttcatgtcagcacttggatgtcgttataggaatgaacctattttagggttgttaatgatcccaggacccatgatcatttcagtttagggaataatatgcacacagtttttgaatgatatgtttttcagacagtgatagtctatgtgcactttttaatttattgaatattatttgcatgtaatttgataaagcatttacacatgttggaaaatatgactcatacacagtcagtggttgatggtaagtcaaaaacttttgtaaatttctatgggtgaaaaatctaaagctccacctcaaaatcccaagtctgaaagagatctttgagatttctaaagccactttttaaaatttgcacactatcaactgcagactctgagaggttggggggttaccaccagaggcacttgtaccacacaggctgcaagcatgatctatggaatagataaataatattttcaaaacaaatactatgctttttcaaatgtatatagatgtttatatgattaataagagcagaaacagacagatgagattgtttttaatgtagaaatcccgatcagtggtttctaaatacactcatatagtaaatattttcttcaggctagaaaccacacaccttatctaagtctctatttcctataaggaagctgaaacttagaaaggccaagtgatttttggagtggcacagctgaaagtggtagagcagaatttagaaaacataccttcaaacaatgtccaactttccacaactatcttgaatcttttaattaaagttttaactttgaggattgacatgcagttgtgaagttatatgcgatgatcctgagtacactttaaacaatttccctcaatagtttacattttcaaatgatggcacaataaagcaacgaggatactgacattgataaaataaactgatgtttttcagatccacaattttacttacatttgtgtgtgtgtgtgtgtgtgtgtgtgtgtatgtgtgtttagtgccatgcaattttatcacaggtaaaatgtcttaagtacatcacctgcatcaagatacaagcagtcatcgccacaagaattcctgctgttgtgctttaataacaataacctctctctcttaccctctccacctgacttccttaacccctagtaagcaataaattgttctccattttccaaactttgtcatttcaagaatgttgtataaattcaatcatacagtgtgcaggcatttgggattgccttttttcactcagtaatattccttcaagattcatccaagttgttgctcatatcaacagttcattcattttttatttctgagtagtattccatagtacccatgtgccagtttatttagccattcttccattgaaggacatttgggttgtttctactttttggcttttatgaataaagctgatataaacatgcatttcaattttttatataaaataagttttcatttcactgagataaatgttcatcattaagattgccagattgcatagcagttgcatgtttaacttaggtcaattttgttgttgttttaacagatttattgagctataattcacacagcttataactcactcgtttgaagcatacaatttaatggcttttagtatatctacagaggtgtacacccatcaacataatcaatattagaatattttcattacccttaaaagaaacactatacctctaaacattaccctcccatttatccaattcctcaagccttggtataccactaacctactttctgttcctatagatgtgcctattgtaaacaattcatataaatggaatcatgcaatatgcgacttttgtgattcacttctttcacttagcataatgtttcccaggttcatccatttcgtagtgtgtatcacctagattttcaaattgttgaataggatttcactatatgactatatcatattttacttatacatttatcagtgaatggacaattggattaactataccttttgggtatcatgaataatgcttttcttaatatttgtgtataattttttgtgtggacatagtgttgtcatttctcttaagtatatacctagaagtaaaattgctggaccatatggtaactctatctttaactacttgaagaactaccagcccgtttttcaaagcaggtgcattatttcattttacattcctacctgcagtagatgagtgttccagtttctcaccatgtttgccaacacttgctattttctgtcttgatacagatatcatagtgggtgtgaagtggtaacttacagtaaaggtggttttgattggcattttcctgatggctaatgatgggaagcatctttgtatgtgcttttttggtcatttgtatagattctttggagacatatctattcagatcatttgaccattttaaaaaattgggtcgtttgtctgcttatcaccaagtagtaattaactattctttatatattctagatacaagtgccttatcagataaagcaccatatcagatttgcatttttttctcattctatggcttgtctttcactcccttgatggtgtgttttgaagagcaaaagtttttaacttttgatgaagtccagcttttttgtcatttgttgcttatgcttcttgagtcacatctaagctttattccaaatcacaaacacttgtacctatgttttcttctagtatttttattacattacctcttacatttaggtcttaactaattctgaggttttttagatggtgtgatttatggggatttcttccctttttttttcttatccagaggcttaacttggaacttcttgcactatgttgaatcaaagcggtgacagcagacatctctccctgcctctgatcttagggtttctcactattaggcctttcacttgttaaaacacctacagctttttaaaatgctatttctctagttgaggtatttttccattattttcggcttgcctggagtctaccctacccctatggatatgttttgagatttgtttaatgctttttttatgtcagtttatctgatcatatttttcttctgtagcctgttgatatggtatattacattgatcgatttttgcatgtcaaaccagcaatccctggaataaatcccacttagtcagtgtaaatatctctttatatactgttggattcagttggctaatattttgttgagacttttaatgtttaagctcaagaggaagatttgaatatagtttatttgtttttgttctgtctttggtgttgctacctgggtactggccttaaaaatgagttggaaaatgatctcttctttaattttatgaaaggggctgtgtaaaattattgttaaaagccttattcaaatgttgtgtagaattcaaaagcaaaaccatttaagcctaaagactttactgggggaaagattttaaattatgacttcaatctatttaatgattatagaataatttagattaattatcctttttgattgagtttttacagtttgtagttttctgtcgaacttctgaacataaagttgtttatagtgttccacaattacctttttaatggtttcaggatttgtattaatacagcctcttttattcctaatattggtcattcgtgtcttctaatttttttgtcatttgtgctaacagtttaattttattgattcttttagaaaaccagtttctttcatttttaattgttttcctgcttttacttttacttatttcttctcctcttctgttttatttcttctacttgatttggtttccctccccactactttttaggtaggaatttagattattgatttgagattgttctgtttctaatgtaaacatttagtgttatacatttctgtcttattactgtttagctgcatcccacatgtttaatattctatatcttcatattaattgagttttatatatttttagatttcctttatcatcttgcattattttgcagtatatggcttaatttttaaggtttcagttattttcttattgtcttgttattgatatctagcttgatgcacttattgtcagagaatttcaattctttcaaatttgttgagatttatttcacggctgtggatgtggtcattcttggtgaatgcttcttgtctatttttttaaaatatgtattctgctactaatgggtaaaatatggttggttgattgtgttcttcacatcttccatatccttgctgattttctctttatcaattatatcagatattgaaagtaagatgatggaatttttgtgtttttttgtttttgagacagggtctcgttctgttacccagactggagtacagtggtgctatctcgcctcattgcaacctgcacttcctgggttcaagcgattctcctgcctcagcctcctgagtagctgggagtataggtgcatgtcaccactcctggctaatttttgtatttttttaaatagagacaaggtttcgccatgttggccaggctgatctctaactcctgacctcaggtgatatgcctgcctcggcctcccaaagtgctgggattacaagcatgagccatggcgccagaccagatgttggaatttctaactccaattatggatttgtctatttttttttcaactcttatcagtttttgcttctttagggttctgttgtttggtgaatacacatttaagattgttatgtctttctgctaaattgatgctttcatcattacacactgttgctttctgtttctagcaattttctttgttttgaaactattttttctatcactaatgctgccaattctgccatattttattaatgttcacaagctaaatattttttattttttttactcacaacctacttgtgtctttgaatagaaataagtttcttacagtcagcaaaatctgatttatctcagtagaatttactttttcttggtcagcattgaattttgagaactttgaaagataatttgcccacaaacaatggtttaatgtatacatttacatattgtaagactgagtgaattttccaaatattttaagcatttcatatattttgtattttatttccatacataatatgtgcatatttacccaaaattttatatccttgcattgtgaatctagtcaaattaaggaaagtgatgattaaatacatacagagacttgattgaccacagacatattaaagagctaatgactgcagacttagatttaatcctcctatcaaactagttaaatttacaagatgtttaagatatattcagacccataatgacacaagtgcatatttttgtttctttagggaaaggattgtcacattgccttgcaagaggcattaaggtgaaacaccactaatactgtgaatttattcaagtctggagttcttgcatcagatacgtaatctcagatatccaattttattagcaaaataaaagtggatacactttttagaagttggaacacaataacaaaacttcagagatgaattcatagaaacaggaattgaaaagactgagaatttccagagtatcaagaattctcacgtttgcatcaccatgcatttgtatatgtcacaatggcaatttactgtcatgtatcttctatcaaaagacacatgcttatgaggacaattatgaagagaataaaacacaaagaaatgagatgactcaagtgttaaatgtcatcaggccatgaaatgagaacagcattgccagtaggatcaggatactttggctatcttgtcactgaccactgaaatcaaagcattggcttatccccctgaggaagcactgacagttcattgtcatctcttcttttgtccctacatttatgaccaaaccacttctgatcaatgcattctttgtaaatagaaatagtttccatcaggtcatactattgttgtatcacccttttctcctggaaaccattgctttttttttttaaatataaaatgacttaatagcttttttttaaaaatataaaatgacttaatagcttaacactaactaaagcaatttaactttcacaaagtaaaggtaaacttaactgtagattcaaaatgctgaaaatatatgccaaagttgttatagatgtcagtgatgcccacatttacatatctcaagctctaatctcctgcagaacgtgtgttataggatgaggattcacaacacaaactctagccagactacttgagttcattttccatctatagcaacttactaattgcataactctgggaaatttagtaaccttgtcatgactctgtcttctcatatgtaaaatggtgacaatcgtggtaccagctaactctggggctattataagattaaatatggaaatacacataaagtaacctacacagtgcttggcaccaattaagaactcaatacatgttagctatttgtagaaattgtcagcatcatcacgtgtaagatgactaaaacagaagctttgattcccatattcatacttaaagatagttttgcctcatctttggaaatggcatcagctcagtttctcaggaccatgaatttgacattgatgtatctttctatacttcactcctcctttccagcagaaagctcttcattctctctctccagatcataactaaacccatctccttctgcttaccttgatggctcccaccatcactcctacatagatttgtacattcatctcctaatgaactttcccgtttgcactttttacctttgcacttccaccacaccacaatccttcatctgaaagttagaaaaagtcatctttttagacccaaatatttgctgtcaccctcaatgctgatcactgaaaacttccactgtggcctgtgtggtcatccacaatctggccctgcctacacctccaacctcatttctcctgaatatgggttcctgtggctcttgaacacatccagctctttcctatctcagggccactgcttgctctgttttttctgcctacgggctctgaccggacgtttacctcctggctccttcttataattctggttgcagctcccctgctagcttctcaaggagctgactctttacaaccatgtctgaaataccctgcaacccttgatgctcttgtccacatcaccatgttttattgtcttcagagcagttgtaaatttcatacagtatcttacatttattatttacttccctctcactggcatgttaaaatatggattcccttgtaatgttaagtgcttaggaccgtgattggcatacagtgattcctcagtaaatgtagaagaaaaaatttaagaaatataaagccataaagtgagtaattaaatatgattgagagaattccataagatttaggttttacatcaccagcttaaaatagttattcaaatatcatgagtcaataaaataatcaatttacttattggcaggtgattttcaaatgaatgaattggattatgttgcatagttaataaaatgtgatacattgaatttactgtaattaggaaatgtctttcactaatgcctggaaaaagataacgtaaagcatcatgttttttatcttatttttgtttagctgtttgcagaataaaaacaattttaattttacataacaaatatcctgaggcaagcaaatgaacaaataaaaagatgcataaataaatagaataaataaaatcgcattttaatttcaaatccaatttagtgatactgagttgctaggcatttctttggttataacctatcaaaaacattaaattctaattacatactacccttaagaaaaatatttgactctattatattttgcttttattgcatcttatagaatactataaaattcttattaaacaacttgtttcaggaaatattatagacgttttcaggatcatttcagaacatttaaccactgatccaacagaatgttatgcattttgttataagtactctggtagtttaataaaaatataggagcttaagttcttaaatatgctgtttaaccaatatggagggtatttgccaaggagggagtacatttgatgaagtatatacatacaacataaatccactaccttcctaatttactcaaggtgtagatatcttcctaggatgttttgtctagaagactaagtctatggcacctcctttcccgtgatagtttctcagcttaaaataaaccccacatcagctgggcactgtggctcacgcctgtaatcccaccactttgggaggccgaggcaggcggatcacaaggtcaggagttcgagaccagcctggccaacatggtgaaaccccgtctctactaaaaatacaaaaattagctggccatggtggcacacgcctttaatcccagctactcaggaggctgaggcaggagaatcgcttgaacctgggaggcggaggttgcggtgagctcagattgtgccattgtactccagcctgggtaacaaaagcaaaagctccatctcaaaaaaaaaaaattaagtaaaccccacatcataatagctttttcattttcttggctcttcctcccaactttactgcggtatacttgacaaataaaaattatatacatttaagatgtactgtgtggtattttgatatatatatatataaacaattaccatagtcaagctaattaacatactcatcatctcacatagtttttaaaatttgctttatttttgtagtgagaactggagtagcaactttctggaaatactgtcaatagtaatacttaggataacaacacgatgtcaagtttaaaaataattaattaaattcctttccttttctcccccctccatttttgtgcgtttgtatatctatgctatagcaatgaaaatgtttccaggcagaaatgaacgcagacattgaagtaaaaacatgtgagctcataattccttttccatgttccatgttgtaaatctgcagtgaagaataaatagaaactattttcacttcagtgtttaaaataatacaggatttaatgggaatattctaattgcatgatcttcatttatcttcacagacaattccctctgcacgttgactttgtaccgttatatctgtcgaactagctagtcaccagtggtttctaacacctactaaatgatttattgaaaaatcctcaaatggaaataaaaaacagtaaagaaaatattgtagtcttatgtggaaaactccactggaaaaaagaaggacgatgaatttgattatagcaataaatgcacaccatgaatatcattaaccatcacttattctttcgtcagttcttttcttttctttttttttgaaagacatataaagccattctgctgtcaccaacagtcatcttacatttgtcttaaatgtgccttctcttatgaaagacatcaaaggtctatgtgattttgcatttagtattgctgctgtctctctttcatttgtttgttacttttctgtgcaagcaattccaatgaacttttacaaacttgaaaacattcttatttcctacatatgtggctttttttttaccagtttatttcaaaatccaaactaataccattactttaaaaattgaactattaatttacacaccatttaactttcaattgcattctgaacctaatttaactttagatttacctttaagccattaagaagataagattagtcgaaatacaattgtaggccatatggttgtttcaggtctctccatttctgatgtgggattttattttgaatgggcttgtttacttagctcagtgtgaaattaatcggtttctcaaactacccttctagctcttacattttgttaaaccttttttagtcttccctttgacaatctgtaagttgctttcttttgaattcttttcaaaatatagttaggtagttatgactcatgtattatttttgttaggtacaaacccacagttgaccaactttctctttttgttggagtttgaggatccacaccctgattttggttgccttggctgatgtcttcagcatgagctcttgtagatgctgcttccagattcatggattgcttagggtcacccacagatgacctggaatgatgcagtgcacacagacccctgtgtctgcagtactcgggcacacagcctgctggggcctgttgcagggtctccatcaaccgttgctgcatgaatgattgcagatatctttcatgcaaattcagatttttttcttccctaaagattcctctacgtgtatttcatcatcttttcacgtccaggcacacccaaacattccagtaacaacaaaaatcagacaaaatacctaggaaagctttcaaaataaatctgagggtctcctatgaagaaaagtacaaatctttgttgaaggacataatagatgtaaaggaacagaacgcaatcagttttggtccttgatcaatgatctacatgagaatatttccatcttctcacattgcaggtttgatgcaatcctaattacaacctctgtgggattagcgggccggactgagagaggctctgggaatgttactgtcacattcatcaggcattatcctcaggcagattacccgtgcgtggtatccttgttaattgtagcttttcttgccaccggacttgtactttcttctcttcctcagtgaggagtcaaaccacagtagtcactttcctgagtgaaaaatcatttccaaggtgtttgacacaaagagatcctgaggacatttgctgtcgtctttgtttgagtactccagactcagggagctgggcttgcgctgcgggaggtaaagctggggccacacccccacccctgccagccaggacagttcctagacccttcccctgagctaggttttccagtcgcatggagcactttctcacatattccacgctactgatttatctcgcttattttctacctcttctacacaaatggatgcccaattgtggtaggattctttttctttctttctttcttttttttctgttgattcactacagtatctgtagtgcctgaaacaatccatgatatactctgtggctgctgttgaatgttgagtagatggctttgattttgcttttgctcagctgatgttaacagtccttttcccctgctgctgctgtcttgtcagtcagctccctgtgcgtcttcctaatctattcacagttacaattacttaaaacattatttttaaattgcaggttttataaagctatcatgtctgatctcttcattgcagtacattgttcttgacaaaattgaaaacaagcaaaaaatcatatcttatttatgatttacaatttatctgttttctccagacagttgataattgtcactaccacttataaacttgtatccagtaccttcctttcaaagctagatgctagggtgacagaaaaggtttataaaggaaaatgtatataaattaagtatccaagaacagaaaaagggaaatgaagtttgggctacttataggagtgaaaataaactctgtgatgtgccagcaccagcacaggctcttgtagtttcctcccaactttgggctcagtggtatcatgttggtggccagtttaggagtatttatatcacaaaatccacaagtgctgcaaatcaaggcttttctattctagaatgctggttgataaataatagcctcaacatttaccagaacactataaaacaattcagtgatcataaagttattatccacagaatatttactggcatggaaaaatgttcacaataaaaattggtgtttaaaattgtttattgcaaaaaattgtgtaatgaaatcatcttgaaaatacttgcattactaagatataaatggttctctctgggcagtgagattgggaggaatttttttttttttttttttttttttttttttttttttttgctttctctccagcagcttgacaatacagcttcacaagaagataccttttccttttaaaacccccactgtgttctccttcctcctgacttctccccagagtacccatgttgaatccctggtgtggatcccatgcttcattcctgccctgctacttgctctgctctcagcttgctgcacaatcccccacccttcctgctgggttcactaagggctctctaggcaaagcttgcccaagctgctctcctcctgcaggtctgtgctaaggccatcggactcccctggggctggttctgcatctgcagcctgtgggtgcttctgtgagcgcaagtcaggctgtgcagcaggtggtctgttcttgtcagtttcttgtcttctgaccgtttgtggggctgtattggcagtaaaacacccacgacacagagaacattcaatgtatgtttggtaaagtagtaaagaatggatgcatgtgatactaaaaatataatcattacaatagttaataaggtattttaatgcaaatcaatctttttataatattttgagaagaagaacatgttcactggggaatattaaaaacagatcttagctcagacgtgttattcaaatattgaggaaaaaataaacattatgtgagttctttccgtctttttgaaaatcgagattaaaaaaattgttcattattgtggctcccataatttaaaaaaatagcttttcttttgttattttaacttttaaaaaacgttttggaaaatgtagtgaaaacgtatcatccactaaaaactaaaagcattttgtttattcttgtgaacagatgcaatcataaattcaatctgattttttttcctcttagaaataaaaccattaaatcagatgacataaatacccatgcacctgtgaattactggtcaggccaaatgactagtttcagcatccaaattccataaaagcaagctgaatagggcttctgtgttagagatttgaaattgaaatgaaaaatcaaagcaaaaacaaaaacaaaaagaaatgatttcaattccattctgcaaagcaaaattgagtttcctggtcaggttctctattgctgcataacacagtacccacgaaagtgagtggtttaaaacagccatcattttattttatccaatcaatgtgtgggttaagaactcaggcaaggcattctcagtcaggtttctaccccatgggttgccattcttggtcaaaatgtgtccagttagtattctcacttgcaaggtgccctgttggggacggctggaggctgagcccttctcgtctccttcttcatggagggtcggacttgccacagtcatttagctgcatggttgttattcttacctggaaagttagggctccaaaggagagtgttccaggaggcagaaagtggaaactatccgtgttctaaggcctggacccataagcaggtacaatctatttactctgcactctgttggccaaggtggtcacagagattggtcagattcaagtggagatcccaactcctaagggaagaatacaaaagaatctgtggacctcattagtccatcacatatacatgaacttatttttcctgtttttgagacagagtcttgctctgtcacccaggtcggagttcagtggcatgatcatagctcactgctgccttgaaagcctaggctcaagctattctcttgcttcaacctcctaaagtagctaagactaagtctttttaattttgttcagagatggggtcttgttatttttcccagactcacaaacttgttctaagatataacaagattaaatatatatatgcatatatatgtgtgtgtgtgtattatatacgtatacatatacatatacatatttatttatttttgagtggaattttgctttttttgcccaggctggagtgcaatggcgcaatcttggctcactgaaacctccacttcccaggttcaagagattctcctgcctcggcctcacgagtagctgggattataggctcacaccaccatgcccagctaattttgtatttttagtagagacagggtttcaccatgttggccaggctgatctcaaattcctgacctcagatgatccgcctgcctcggcctcccaaagtgctggggttacaggcatgagccaccactcccagcttaaaatatgtatattttgatagagaacatactagtactaaaaaaaaaaaaacctaagattaattatgcaacaataaaaagtttcagttgatacatttttgccatccaatagagataagcatcaggaataaaatataaaaatgttaagagctgattcatattttgttcttttccattaaagaatactattttcttgctattatattgttcctagaaatttaaattatcaaaatacagcaaaatgaaccccccagtgtgattggtaccaactcattcttgaatgcatttttgaaagtcaaatatcagaaaattaaatagcagattacaatttagtattatggctaagaccttgagcttttaattcagacagacatggatctatttgccttggacaagtaatatgtttcttggacaagtaatatatgaagtatgatggttcactgtgatagctagaggaaaaatagtaactgctatagagagttgtttattattaaatgagaatacatatgaatgacttaacatagtgctgagacatataggtatccaataagtaatattatttttatgagtgatacagagtggttctattccattttacacgttataaaattgaatatgagttattctttaggaggaagacactaaataaacattaaaaaattctaaattatggcttatacagttaatacttgcctgagctcaggcgttttaaccagaaacataataatagaaatccaagcatcttccctttcatgagttaactgcctacattagttttgtagagctgctgtaacaaagtaaatataatactttattgttaataaagttaattcagtgagaaacatcatacttttatcttgaagtacttgaagatgatgtacactcttagaagagttatgtgggaggaaatctgatcatctctaaaactaaaatagcaaagctaacattaatacaggcatacctcagggatatcatgggttcagttctagaccacagcaataaggtgaatattgtaataaagtgaatcacacaaatattttagtttcctagtgcatattccggtttaactgcagtgtactaagtgtacaataaaattatgtctaaaaacaatgtacataatttaaaattatttataactaaaaaatgctcacagtcatttgagccttcagtgagttataacatttataccagtggagggtcaggcctccatattgatggctgctgactagtcaggatggtggttcctaaaggctggggtgggtggggcaattttctaaaatgagacaacactgaagcttgctgcatcagttgattgttcctttcatgaaagattactctgtagcatgcaattctgtttgatggcactttaccatcagcagaacttttaaagttggaaacaccctctcaaaccctgtcactaattatcaaacaagttgatacaatattctaaaccacttgttgtcattttaaccatgttctattcaccaggaatagattccatcttgagaaaccacacttttttgctcatccataagaagcaactcctcatacattcaagttttatcatgagctcaataattcagcaattcatacatcttcatgctctacttctaattctagttctcttgttatttccatcacatttacacttacttcctccattgaagtctttaacccctcaaagtcatcatgaggcttggaatctacttcttccaaactcctgacattgttgaaattttgacctcctctcatgagttctgaatgttattaatgacatttggaatgatgcatttttccaggttttcaatttactttgccaaaatccagcagaagaatcactatagccttagaaattgtattttggaaattataataccagcaactcaaaattactctttgatccatgagctgagaaatggatgttgtgttaacaggtatggaaaaaacattaatctccttgtatgtctgcctcacagctcttgggtattcacgtgcattatcaatagcagtctgcttttgaaagaaattttttgaaagagattttttaattttaatttttttctgagaagcaggtcttaacagtgggcttaaaatatttagtggaccatactgtcaactgatatggtgttgtccggctttgttgttccatttctagagcacaagcatactagatttcgcatccttcttaagggccctaggattttcagaatggtaagtgaacgttagcttcaacttaaagtcattagctgaatgagcccctaacaatagagtcagttagagactactcatctctagttatgaaagtcctagatgacttcttcttccaatataaggctgttttgtctacatcaaaaatctgttgtttagtgtaaccaccttcatcacttaccttagctagatcttctagataacttgttactttttctccatcagtacttttatgttatgatgatgacttcttttcttaaacctcatgaatcagcacctgctagcttcaaattttcttctgtagcttcctcacctcactcagccttcatagaattgagagttatggccttgctgtggattaggcattggtttaagaagagttgtggctggtttgatcttctaactatctagatcactaaaactttcttcatatcagcaactgtagagttactaacttacctaatttcaatattgttgtggctttggatcagggaggtccgagtagagtgagagagatagagaaacagctagttgttggaacagtcaaaacatacacatttatcaattaagtttgaagttgtatatggtcgtgatttgtgccaccccaaaataattattatagtaacattaaagataactggtaacagatcaccacaacataataataatgaaaaagttaatattgctagaattaccaaaatactgagaggtgaccgtgctggcagcccttgctcactctcagtgcctccttggcctaggtgcccactctggccgcacttgaggagcccttcagcccactgctgcactgtgggagccactctctgggctggccaaagccagagccaactccctctgcttgcgagggagtggggaaggacaggtacctgagggaaccggggctgtgccccggccgcactcgcggcgcacgcgagttcggggtgggcatcctctccacagaccccacacttggagcggcctgccggcgccactggccccaggcagtgaggggcttagcacctaggccagcagctgcagagggtacactgggtcccccagcactgccggccgcccacactgcccccatattttcaccaggcctcagccgcctccctgaaaagtaggactcagggcctgcagcctgccatgcccgagcctctccgcctcccccctgtgggctcctgggcagccggagcctccccaatgggagctgtcccctgctctgtggtgcccagtcccatcgaccgcccaggggctgagcagtgcaggcctgcccgtgggactgactgactggcggcccctgggtgggatccactaggcaaagccagcaaggctcctgagtcgggaggagacttggagaacttttatgtctggctggaggattgtatatgcaccaatcagcactctgtgtctagctctgggttcatgtatgcaccaatcagcactctgtgtctagctaatctggtggagacttggagaacttttgtgtctaactcagggattgtaaacgcattaatcagcaccccgtcaaaacggaccaatcagctttctgtaaaatggaccaatcagcaggatgtgggtggggccagataagggaataaaagcaggctgccagagccagcagtggcaacacgttggggcctgcttcctacgctgtggagctttgttctttcagtaaatcttgctgctgctcactctttgggtccgtactgcctttatgagctgtaacactcactgggaaggtctgcagcttttctcctgaggccagcaagaccacgaaccccctgggaggaatgaacaactccagacgcgccgccttaagagctataacactcaacacgaaggtctgcaacttcattcttgaagccagcgagaccaggaacccaccagaaggaagaaactccgaacacgtcagaacatcagaaggaacaaactccggacatgccacctttaagaactgtaacactcaccacaagggtctgcagcttcattcttgaagtcagtgagaccaagaaaccaccccttccagacacaacataacagatcatacaaggtgcaaattgaccacaaatcttcaatttgtaaaaaatccaatatctgtaaagtgcaatcaagcgaagtgtagtaaaatgaggtaaacctgtggaagcttgatggatagagccttagaaattttccattaagccaaaaggttggcattgatgtgagcttgagccagcaaattccacatgctaatttagttgaggtcaagccctttttctcagtcatacatctggcaaggattgttctttaggtaacatactgaaagaaacaaaaacaaaaaaaaacctgaattcttttgtgagttggtttatgagtattaatagtatgttagtatactattaatgtttaaggttggacaatgtaggttctataaaaatgtatgaattccaatgcaatgaattggtccagaataaaattgtttctttccaagaagaaccattttgagtggactataaaatatgaccacaaaattatattaccttgattactattaaaatgaaaaactgcttaggataaatacaaatcaagagatagaagctaatatatatttaggcctaaatattccgtcgtaaaaatatgaaaattctcaggtgtctaaataggtatttcagatctttctcttggtttttatcttatatatgtaggcaccttatttttctatgtaaattatagtaattaagctttcatatactcctaaggtacaaaatgttgagttccttggaaaaaaataactttgcaataatcattataaattataccactgcattatttataatgtataccgtatttagaagtttaaatgagtggtaactcaggagatatccagaactttattttagtgtgtttttaaaaaacatttaagtagatttaagttaaaattatgactagccaaagccaatctaaatgggtaaaatacaaaacaggaagtatagttgtcagtgacacaaacttttcaatttcagtacaatggatactatttttcaaagtgcaaagaaacatcaaaattaggtgactgtcttttctgcctctggcttaacgttctatatttactcctggatgtttggtttggtggcttttgtagattgacagactgcaaatgcacaacacaacatccaactgcatattttggctacaaagtagttagatacagaaatgatgaattcgatattcaatttggcagttttgtgtagaattattcttacattttttctttattccttccaaatctggttggcagatattttgactatcatgaagggcaggataactaaagaaacattttctggcacatatctggcatgtagatcattttaccccttcataattttctagtattattatacaggatattactaagagctaaatactttatcttcttcagagcaataattttttctgtttttctctttgaggataacactgaattcaaatcagtttagttttctgacacataatcactcatattatggttattaagcattatttaatagaacattctgagatatatatagtcaatatttgtctaatttgtgcattttaaaagctttaagctataatttgtgtaagataaaattcacccattgcaacagataagttgtaattttttagcaatttatactattgtccaaccatcatcaaccatcattagaactaaattttagatcacttccatcatcctaaagtgcttgcttgtacccctttggagacaattactgcttccaacaccagttattttggtgtgtgtccaagaatctttgcctaaatgaatatcataaagactttcttgtgtgtgtaagcacatgtatgcatgtgtgtctgtgtgtgtatgcatatgttttaaagttttatagttccaactcttacctttaggtctttgattaaattgagttggtatttttatggtgtgaaataatggcctaaatgtgtgatgtgtgtatttatgtatgtgtgtgtgtgcatttgtaattacatctatatgtacatatatggatatagatatagtatccaattaagggactttcccaatttaattgtcatgtcatgtttgttgaaaatcacctaaaaataaatgtgaaaccttactgctgaactaccagttcagttccattggtttatatgttgtctttagagaatacaacactatcttgatttctgtaagataataagtttcaacactgtataaggtacatcttccaccttttcttttcatttcaaaattattttggcaattctagttcctttgcatttacactttatgttcagtttgtcaatttctatgataaatgacagttaggcttttatagagattccattgaatctatatatacatttgcagagaattgccttcttcccggcattccatgaccatggaatatttctgtatttcttttgatcttctgtactccttcttagcaatgtttggtacatttcagtatataagtttgcatccattttgttaattttattcttagatacattataattttgtttgctgttgtgaatgagatttttttctttttttacatttatttttattttactttaagttctgggatacacctgctgagcatgcaggtttattacataggtaaacatgtgccatggtggtttgctgcacttatcaatctgtcatcttggttttaagccctgcgtgcattaggtatttgtcctaatgctctcctttctctagccccccaaccctcgacaggccccagcgtgtgatattcccttccctgtgtccatgtgttctcattgctcaactcccacttgggagtgagaaaatgcagtttttggttttctgttcctgtgttagtttgctaaggatgatggtttccagcttcttccatgtccctgcaaaggacatgaactcattttttatggctgcatagtattccatggtgtatatgtgccacatttctttatcccatctatcattgatgagcatttgggttggttccaagtctttgctattgtaaatagtgctgcaataaacatacatgtgcatgtgtctttatagtagattgatttataatcctttgggtatacacccagtaatgggattggtgggtctaatagtatttctggttttagaaccttgaggaatcgccacactatgttccacaatggttgaactaatttacactcccaccaacaatgtaaaagcattcctgttcctgcacagcctcaccagcatctgttgtttccagactttttaacgatcgccattctaactggtgtgagacagtatctcattgcggtcttgatttgcatttctctaatgaccagtgataatcagctttttttcaaatgtttgttggccacataaatatcttcttttgggaaatgtctgttcatatcctttgcccactttttgatggggttgtttgtttttttttttcttgtaaatttgtttaagttccttgtagattctggatattagacctttgtcagatgggtagattgcaaacattttctctccttctgtaggttgcctgttcactctgatgctagtttcttttgctgagcagaagctctttagtttaattagatcccatttgtcaattttggcttttgttccaattgcttttgagattttagtcctgaagtctttgctcatgcctatgtcctaagtggtattgcctaggttttcttctacagtttttatggttttaggttttgcatttcagtctttaatcaatcttgggttaatttttgtataagtataagaaaggggtccagtttctgttttctccatatggctagccagttttcccagcatgatttattaaatagggaatccttttcccattgcttgttgaagatcagatggttgtagatgtgtggtgttatttctgaggcttctgttctattccattggtctatatatctgttttggtattagtactatgctgttttggttactgtagccttgtagtatagtttgaagtcaggtagtgtgatacctccaactttgttctttttgcttaggattgtcttggccacatgggcttgtttttctaatttcattttctaatggcctttgctgtaatataaaaacacaatgtatatttatggtgatctttaacttgtgactttacaaaacttgtttatgaattataaaagttttattgtggttccatactattttctatgtttttatgatatacagacacatttatcattatgagatgtccttctcatcgctgtactatttcttgtcttaaaatctattttgtctgttattgataaaactaggcaaattctctgatggatacagttttagagtataccatatgctatccttttaatttcaatctttttatgtccttgagtataagatgtgttttttgttgatgatataaaattgtatcttacatttttatcaagactgatgatatatgccccattaatagaaggtttagcacattcacatttaaacttgttattattatgtgttgtctgtcatttgctactttttaaacagttgtgtcttttcagttcctgtttctcctttactggctccttttgtaccaaataagtattttcagtgtgccattttaatttctgtttatttttgctgtattattttgagttattttattagtgttggtttatgttaggggttggcaaacatttttgtaaagatagcaaatattttaaactttttgggttacatgatctttgctgcaactgatcaatttgttattgtagtatgaaagctgacacagccaatatgcaaatgaggaactaagtctgtttttcaataaaaatgtacctgcaatcagttagcagcccagttttatctatgagtgatagcttatccactcaagttctgggcattacattgggtatattaacttgttcaatttacttcagaattataattgcttattctaataaaatatatcaattttgctccaacttattttcttttcttcctacctcttttgtgctaatattgtcatatatatctatatgttataaactccaattacagtgtcatgattatctatgtataatatctatatttaataagttaataaaagatagagaaaacatttatagaatctttcatgtatgcccacatatttaccatttgtgacacttttaattttttctgtcaacttgaattcagggctgctagcaacagtttttttccaaaaatatttatattttgccttcatttttaagttttgctggttataaaattctttgttgacaaatattttctgccataatttttttgtctgttatttctaataagtcaagcaataatcatgttgtatatgattggtcatttatctctagcctttaccaagtttactcactttttggctttcagtagttagactactatgtgtagatgtgttatctctttgtctttattccgtttggcatttatcaggtctcttaaatctataggttaaaattttccataaaattgagacattttcaattattattttttcctgtactatttttctgtccctttcactttctcctcttcttcctgtggtgtcatttcatgtatgttgctatgcatcatatatggtgtcttcccacaggtgtctgaaggcctgttcacttcgttttttttgtttttgtttttgtttttgtttggtattttttagatggagtctctctctgtcacccaggctggagtgcagtggtgctatcttggctcactgcaacctctgcctcccgagttcaagtgattcttctgcctcagccttctgaatagctgggactacaggctcatgccaccacatccgactaattttgtatttttagtagagaggaggtttcaccatgttggccaggatggtctcaatctcttgacctcgagatccactcacctcagcctgccaaagtgctaggattacaggcgtgagccattgcacccagcctattcactttgatttaatcttctttctccctgtgcattagactggaaaattaattttgttatatcatcaagttcattgattctttcttctcctatctcaaatcttatgctaaactcctctaaataattcatttttgttattgtccattttaactccagaatttaaatttgatttattttttcttaataatgcctatgaatattgagttcctctatgtggtgagaaattttcattgtactttccattaattatttagctatgattttctttagttatttgaatatatttataatagctgccttgaagtctttgctgaattccacatttgttgacagagacaaaaatctatagactttaaaaatttttgctaaatattggttacactcttgtttctttttacttttatgcacaataatgagcattttgataatgtatgttgtaattctagattctgacttttccacagtatgtttttgttgtcttgtttggttgtttatataacttgcctggacaaagtttgtgaagtctttcttcctgaaatatgtgcctgtttatttatctgctcctattttttcttcttgtttttatttttaagtctggcttcctacgtaactggtcatcttaagagtgggttcatcttaagagcggtaaaagaatgtgctcaaagactttgagccagtaaacttcctattccctgatgatgaatttatgaatgtcctggagaaagtttttaaatctcaggccattttaaagcttccctggcttttacctccaataggccctttcatgcctcctccacacatgcatttaggcttcttttgccaagaatgtttggatgccttagcacccctctactctctgctggacacacacagtgactcccatcaatcagggatatgtggctagcttaagtcttcctttgactatctgacttctacagctccctattacatcccgtgctactcctacagttcattgtttgccccaactacgacctcaatctcaggctaatggagccactgacctcttttttcaattgccactgagatttccagtttaatgtataatactcccaatgaagtgagtcctttctgacaataggtgtaaagctgctggttttcatatccttccaatttgggttaaactactatgccaacagaactgagggagtcctgggactagtgtggatgaagcaatcacagactgttaggcaagatttttaactattcttagctgaaattcagtagtctcaataaattaatgtttcttagttggttttatgacttttgttaaatcccagagctctaaaactgctgatttgaccgtttgttcaattttgcagttgatttttgaggggaagatttgtcaagctcctcaagccaagagtcagaacaacatttttatataaatgcttatataaaaagctaaagagacttagataattctttacaaatacattgctcaataattgaagtcaattttgcacccataaattatcttgtgatggatacatttaatcaaatgcagaaaatataagcaaagccttttaattaaagaaagggcttctagtaaaacagaaagcaactggaaatctgtgaacttcattatttacatgcacattcagtttttaagcttgtgaattttatataaagcaaaatattttttcactaacagaattctgttaatcagaaatagtgtatgatacatataagctataagataatgcaagcaactacttcaagcattcatttttttggaatgttaatatcccttgtggtggtgtgctaacacagatatgtatctgtgttgtgatatagtcctgtttcctgagaaaatattaactgctaaagtggtgggattatgtttgcttatacttttcatttgttcatttcatcatgccttctgactatccagtcagtaattttgcaacatttgagtattattcaaaattatgaatcttcagttatacaaataatatcaaatggttttcttattctgcaatttctaggaaaaccagaaaagccttaatttgttgatgtaactttaatttagaacctctttcaattctgagttcttcattcttttagcattaaacacacaaattattttattgctatagccattctaaatgtaatagatactccaaaagccatctctaaaagacacctctcacactaagtggttcatgtcgggggaaatgttgtgctaaatagtgtatgctagaaaatatttaagtaaactgtaaaactggccaggcgcagtggctcacgcctgtaatcccagctccttgggaagccgaggcaggaagatcacgaggtcaagagatcaaggccttcctggccaacatggtgaaaccccatctctaaaaaaaaacacaaagattagcctggcatggtagtgggcacctgtagtcccagctactggggaagctgaggcagagaattgcttgaatcctgaaggcggaggttgcagtgagcctaggtcacaccactgcactccagcctggtgacagagtgagactccatctcaaaaaaaataaaataaaaaaaagtagactgtaaaactaattttttgactaaaatttagatgaccaaaatctatatgacctcagataagtcatttgcaggtccttggtttatttcatgacttagatgagagtaaactattgtgctataacatctaaaatcacaaactgtaaacatctctctcattgcaatatgttacatgtgctatggcttaaatgtctctgaaaaaactcatgttgaaatttaattgccattgtaacaccataaagaggtggggtctttaagatgtgattaggtcacaagggctctgcccacatgaatggattaatgctgttattgtgggagtgtgttagttattgcaggagttcagcctcttttttctatctctagggcttgcttgcccttctgacattttatgacacagcaagaaggccttcaccagatgtggccacttgatcttgggctttccagacttcagaacttctgtttttcataaattatccagtctatggtattctgttatagcagcagacaagaaacaaaaacaacatgtttgtaactacaattaatgatgaacatgtttgtagtttaagtgcactcttaagttagatgatgcaagagcaggaagctggtatgctttgtcttctccaggtaatcctatctgtccatgttagaaagtaattatggaagaatttagataaagcctcttttatttacttttattttaaattctaggatattaagaatatagagaaaatgtgtgcaagtcagaacaaacaatttagagcaccaagtctttatagaaaaattcatcagtaactgacaactccatagcagcatctacactctcctttttaaatgtcacaattcacaaaactgacttccttctttcttctcttccttctatactatatagttagtaccagaatgcctttataggcatgggtaggcagtcctggataatgcaaacaaaatatttttctcatgtactttacattcttctgagcaagtcaagagcttaaggatttgaagatcaaagataaggctctatgcacagtgtaaccagcatcctcatagtatcatcaagccctcaggttctttctgtctctactcctctagtgttaatttcattcttaggctggtctcctcattgtcacatttagtagacaatctgtgctgcagtctgcactgcatgcctgttcatattcagcaggatataaagtaatcctgacctggagcctagaatgtaaatcattatttttcatctgattagctcattaattcatccaccaaaccctggaacagtaaacatctttgggaactccacatgctctcacaatttctctcatccatggctgtactttagggtttggaaaactcttataacacacactgatgcccaagccttgtgttggaccactgaaatcggaatctctgacactggggccttgtcaatggtatcttttataggttccacattttctgccggcctgaggactgctggcgtagcacaatgaggatttacttttttgtcttatgatgagttcatacccagattaaactggaattctctgagagaaagaaaaaaaaaaggatcgatttggggtagcaaccaactatgtccatacaagctttcatgattttcttgagggttaaaacaaatgtggaacactgtgcagcagaagaaaaattcagagagacaattgggccacataggggactacagagagctgcatctgatgtttgagttatatcttaaggaattaacaggaattccctacatgactgttaggcatcatcacaattttagtgttgttttttctctctgatggaagtgtggagacaaccatgggtacagaggaagaagttggaggcagggagaccatttggaagctataattgagtaaacttcattaggaaggattatggactgaattaatttagaaaaatggaatctaggcacaaggccacagaagggatatgtagaaaaagggtcaatatgatgtaataatcaattagtgttgccctgcatgatgagggagataattttttaggctgatggccagttttctgcttgaaaggtcagatgaatgtctgtatcatttatagagataggaaataccaggggaaggacaggcttgggagataatgtcatgggttatgtttgaagggcctgaggcatgggaggctgtgcctaagatacaagagaatggcaattttgggaatcaactgaatgttcataactagagacatggatttctgtgttgtttgcaagaggtggttgaaaatatggtcttagtgaccatcagtggaaggaaacaaaccaaaaactcaccttattttaaaaagattataagcctattatatattgtgtaaagtactgaagggttagaatatctgcttaaaaagcaccaatagcaaacttgtaggcagctgcagcagtgaaataaaggttttttaaacattggaaacggacattgttttcagaacattctttttgaagatcagcatgtattgtggtattcacacttctaaggcaaggtcattgttcttttatttgtttcacacagaagtcagcttcaaggtcttgtcaggattaagagtaccttcagcttgaggtattacaccattatgttccagatagtttttgtgaaataagtgagagattatcatgtctattttttaacagccctctgtgattgatcttttctgaataagacatggtttagaaagactcaagaatctctggtttgttttcagcttcttcttttagagatataataaggtctctcagttgtaatgtcgtcgggatttgaacttcccctgaaagggtcaagtttgtcttcgattgtaacaagactagtgctcaattacccctcggctttggtatctcaaatagagagcttccacagttccagagcagctgaaactcttagtcatgtggtttactattttatgatgccatgtataaatatttgtttcaataatgtcaagcctctttacacagtgtcaaaatcatgctaaaatgttccaccttttcttgcatacctcttcctacatttctcttttgtttctaaaatattttaggtgctttcatgggaaaaatatccttacatagccaaaccatataatagtctataaatatattctacttagttctgtgtgtatgcttaatcaaagcataaacttaataactttccttatttcaaagtatatgaggataatagtgttattaacctttaaatgtaaacaattagacagacaactatgggcagtcctgttatacttttaaaagtatttagaatttattttatttattttttatttatttattttttattatactttaagttttagggtacatgtgcacattgtgcaggttagttacatatgtatacatgtgccatgctggtgcgctgcacccactaactcgtcatctagcattaggtatatctcccaatgttatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacacgaactcatcattttttatggctgcatagtattccatggcgtatatgtgccacattttcttaatccagtgtatcattgttggacatttgggttggttccaagtctttgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgcacaaaaatcacaagcattcttatacaccaacaacagagaaacagagagccaaatcatgagtgaactcccattcacaattgcttcaaagagaataaaatacctaggaatccaacttacaagggatgtgaaggacctcttcaaggagaactacaaaccactgctcaaggaaataacagaggatacaaacaaatggaagaacattccatgctcatgggtaggaagaatcaatatcgtgaaaatggccatactgcccaaggtaatttacagattcaatgctatccccatcaggctaccaatgactttcttcacagaattggaaaaaactactttaaagttcatatggaaccaaaaaagagcccgcatggccaagtcaatcctaagccaaaagaacaaagctggaggcatcacactacctgacttcaaactatactacaaggctacagtaaccaaaacagcatggtactggtaccaaaacagagatgtagatcaatggaacagaacagagccctcagaaataacgccgcatatctacaactatctgatctttgacaaacctgacaaaaacaagcaatggggaaaggattccctatttaataaatggggctgggaaaactggctagccatatgtagaaagctgaaactggatcccttccttacaccttatacaagaattaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcatagcaaaagaaactaccatcagagtgaacaggcaacctacaaaatgggagaaaatttttgcaacctactcacctgacaaagggctaatatccagaatctacaatgaactcaaacaaatttacaagaaaaaaacaaacaaccccatcaaaaagtgggcgaaagacatgaacagacacttctcaaaagaagacatttatgcagccaaaaaacacatgaaaagatgctcatcatcactggccatcagagaaatacaaatcaaaaccacaatgagataccatctcacaccagttagaatggcaatcattaaaaagtcaggaaacaacaggtgctggagaggatgtggagaaataggaacacttttacactgtcggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgaatgtttattgcggcattattcacaatataatttattttagaagagaaaatttctataggatcactcccagggctagggccgtaagagtgtcgtcttcaagtaacacatagaaattaaacacagcatttcagagccaaataaattaagtaaacatcaattaattgtataccagtcctctgctttttcttcttaaatattataaaatctttgagcaaagtttcaaatttcattagttttctatattactcaggctgtttcacttgcaagtgacaaaatccagttgtaaattggcttaaataaaaggggaattggttggctcacgacttgtaaccgaagaggtaaggatagagctgggtctatgcccatcttaagtgggggactcagaagacatccctggatgcagtttctctcactttgtttctcttctctttctctggattggttttcatgcaagacaggctttcccttcatggtggtaagatagcttcagtcctgtgttctcacaaaatcaaagagcagcagatttagaaagattcatctgcagaaggttctctagaagtcttgatactcattctggaatcaccagctcaggtcaaggtctatataactctttaagttattagcttggccgggtgaagacaatgagctaattgggtcctgtacactaactttggaacccagtgctccccttctctcagattatactgaatgggaatcaaaaacgagtgtgtgatccaaaaatatcaagggctgctgacaaaagcagggaagatgggtacttgggcagacaatacaatcaggaagagccattatatctctgcacatgttgtactagttagaacctgagacacaaagaaacagacagcatatgaataaaatgcattgaaggtaggaaaagaaatagaagaatgaaaagatagcttttctgaaattaaggccacaatggggcccttgttaaaattatgcttttggaaaatttatatagaaaggactagtttactacttttaaaaatgctggaagatggtaaagagatgaggagtgctcacaagaatcttaatggaccaaaaatatgttttcaagatgaattcttactttcccatgaataggaataaacatagtggcatagataattaaaatatttggtaataaaaatatattttttcttaatttggagcaagagaaaatgagattatctatttttcttttttcttatttatatttaaggtgtaaagcatgatgttttgatatacttacacgtggtaaaatgattactacagtcaaggaaatttacataacggtctcgaatttctcttcctttttttttctttttaatgtttgtgcgtgtggtaagagcacctgaaatctactcttttagcaaacttccagtatataatacagtattactaatcatagtcaccattctgtacattaagtctctagattattcaccctacataacttcattgagaaacatcttctcatgatctgcaactcccaatccctggttatcatcattccactactctgtttttatgtcattaacttttttagttccatgcataagtgagatcatgcagcattgtctttctgtgcctggtttatttcagtaaataatgtcctccaggttcatctgtgttgtctaaaatggtaagattttcttatttttaaaatttgaataatatttcactgtgtgtgtgtgtatgtatcatgattctatatttcataagtatatttcacctaaggtgttgtttatgtttttcttgagaataacctgcctgatgatatccctgaagaatggtcaatgagaagttttgtgtaatccataagcaggataataaacagataaaaaactttttaaatttaatttttttttctcctatttgatggtctgtagaagtcccacataattttaattaaaatgtcagatttaatctgagtaaactacagtatgttaggacttctgctgagtgagatagcaatgacaaaatataaaatctgtcacctgggaacgcccagtctaaaaaaaacaaaaaccaaaaactcaaaccaataaaacccttcttttcccacttcgtattctaaggaaaatataatgcctttatttattgtatgccactgaatgagattataattaataattgacttgcatcaggtttgctgttttgtgtcctttagttttctgatggcagaagcctggcccatctggttaagctccccgttcctggaaggaggacatagcagggacttcatacgtggggatgaatcaatgtcaaatgaggaaaaatacaaagaccttaattagatggtcattgctatcagtggacatgttgtgaaaaacctaaatacatcagatttgggaggtttttgagagccactgaggcagctatcaaaatgctcttccagtctcttcctttaggaaggccgtgtttccgtactctgaagtctacagatgtgtttgctcaaaaaccacatttcccatgggccacacccaacctgactgaccggcaggaatgataacaggcagatccatttctggaaaacttgggtgggatttggcgcacacctgattttggcttcaggactccctgatatccttgctgaactttcttcagcttaaatagctacttaggacacttccaccccattttccctctcttcttcactcagagtcagccttgcatcatggattttctagacttcttaggcttcttcttcattttctttcacaggtatttccctaatataattcttgcacattgaatcacatcttagcatttgcttctcaggagactatgactatcacaaccatgttacactgacaaacagttttaatattattcgacagtctctgtggagtacaatgttgctgtgctagattctagtaatgcaaagataagaaagacaacactcccaataaaacatactgtattgggagagagtgtaattcaatacagtaaaagtattataatttacattctatggatttatcccaaaaggaaagcactgtggctggtggtaagacaccagtggatctcgttgaaggagaattctcaagagcaaataatattaacacccatctgtgtagagctagccatgagaagcattgattctagttgtggagcacatatacccaatgatgagattcatatgtgggtggacagtcattgttaatgattccacctaaggaagggtttgccaaaccctaccatactctaaagtaattctcaaacattaatatacatatccaaatgacctggaggtctcattaaaactcagtaagtttaatataaggcctgggaccatatattttctttcaattacaatcttactgagatataattgatatactgtaacaatcatccattaaagtgtacaattcagtggtttttagcatgttcacaatcacatagacatcatcattacctaatattataatatatttatcacacagaccacattttttatatcaaggtgcaaaagggctggcatactcaccagtaattagcaccaaataacactagccactcctgagtggtttctgtgaagccaagtgaaatagcaaccaaaattccatgtggatttcattttagggctggactagaacttcattcctgcctgaagttctttcctacagagtccctggagaaaacatcaggcacaaagatgttatgccatgaaagaatatggtcccttgtaagacctacgagatgctaagtattataaaatttagttataaagtataggggcagttggctaaggtaaagaagtagactgttaaaaaattgtgaaaagtccacatccatggaggagtttgggattttatctgaaggtagtgaaaagccatcaagcaagattaaaccataaagagacatgggataggaagatgaatacagtgttgtgaggtttcagaagaaagatgtgaaagaaatagcagattcaaataaaactgaagattctagtgtggttaacttgagaagataatgaggacattacttgagatagacagaacaaagaaaaaggaaaagccatctgtctatgtgtttggttttcatttatgtatatattttaggatgcagttggagtatgaggcagtatgcggcttgaagatactgatgtctgagtcttgtggaggtgtttgctgaaattatatgtgtgtttgggagtgtgcagggagggtaggaagaagtagataagtagcactgaggacacatcaacacttcaagagtgaacagaggtagaaaagtgtgtaaagaaatgagagattattgtgctaagggaaagaagatggaactgaactgtcaaaccaattcagggaaaaaagttaacaggaaggcttacttatttacaaataagcaaatttactgtttataaatttagtaatgtatgcaaagggcttctgtgcagcaaaagaaactatcaagagaggaaacacacagtcttcaaaatggaggaaaatacttgcaagttatatgtctgacaaaggtctaatatccaaaatctataaggaacctaaagaaatcaacaagcaaaaaacaaacaaccctattaaaaaatgagcaatggatatgaacagatacttctcaaaagaagacatacatgtggccaataagcatatgaaaaaaaatgctccacatcactaatcatagagaaatgcaaatcaaatcaacagtgagatgccttcacaccaaatcagaatggctatgaaagagtcaaaaaaataacagatacatgttgcagagacaagggaacacttataatgttggtaggagtagtggaaagcagtttggagatttctcaaaggatttaaaacagaactgctattggacccagcaatctcattactgggtatatacgcagaggaatataaatctttctaccaaaaaggacacatgcactcctatgttcattgcagcactattcatgatagcaaagacatggaatcagcctatctgcccatcaatggtaaactggataaagaaaatgtggcacatatacaccatagactattacatagccatagaaaagaagaaaatcttgtcctttgcaacatggttgcagctggaggacattatcctaagcaagctaatgcagaaacagaaaaccaaataccgcatattctcacttacaaatgacagttaaacgttgaatacacatagacaaaaagacgggagcaataaacgtcagggtctacttcagggtggaaagtgggaggacagtgagggttgaaaaactgcttgttgggtactatgctcactacctgggtgatgtgatcatttgcacaccaaaccccagcaatgcataatttacccacataacaaacctgcacacatacccccaaacctacaataaaagttgagaaagaagaaaaaagaaatctagtagtttaaggactgaaacctttctgtggatgtgatctctgcaagcatttagatatgtgaatgacagaaacagtctcagcgttgctcaaaatgaagaaagtcattctggacagtactgaggtcaggtggcctattgaggaaaaggtaaaagtctgccagttatacagtggattttatatacaatagatttttatacaagcacatttcataatgaaatccacataagatatgatcctgtttttttttctgtgtgcaaaaccagaaggcagaaagttgtagctatgcaggttactactgtgtacaattgtgacatgcccttaatattcagaaaagaatgtacagaaatgttgtactagaatatgtttgtttgctttgtttatttcttttaaagtgcctttaaatacaggtaaaaaaatgtggaaaaaaactgaagaaagatgtggattttgtttgtttttttagaatctctcctttgtggtcagtttttctttactggtgctttttttcaaattctccaaagtgagcacaagcctatttctaacatttttgttgataaacaaaatacctaaaatatgaaattattttgaaatgtgaaaattatcagaacattttaaattattatcttaattattattacctgaatctaaaaaaaaaattccatgaatgacaaacatttttaaggtcaatagagccccaatctagtaaatgctaaaacctggaaattgcactgtaatatattttaccattttaaatctttataatgatgtgcaatttggttttgtttcctctccaaggtcagatggctaaaaactggcaaatcccaagactaggattcaatttccatcaatgtcaatatccattccacacaaccacccttcttgacagtattgaatttgaggattaggtgaaaggggatagataaacaataacgtaatacaattgtggaagagttcagcactttttaaattacaatagttcaaatttgtttcattgatttttttggctaaggtgtaactctggaaatcttggagcttctgcaaaacataaagaaacttattggatagaagtggcgagtataattgtgaaggaggcgatggggaatttgtcagtgtaaacgatgacatccaaatgaatctacccttgaagtaaataaaggctttccttgagttcacaatacaattattgtaatcttgctgaaaactgaattgtggagtaatatgttttcaagtgaaggggcagtttatatatttctctgttcataatattacctactgtcaatgggaatcataaaatgtgcaccaaaaggtggcaagatataacatatttctgaactaaaataggagatacatattgcaaagtagggactttttccagaaagaatagcttcatgtaagtttgtctttgtttttagaacagctcacaaaaatttggtaagattatccacaaaagttatgaatgagctatcttaatgtttttatgccaaagtagtcattcaggatataagtgaattaatacattctgcaagtatttggatctgagtatgaaaaaaatagtagtagtgttactcaaaaagtagcataatcactgcaggaaaatacaaaacactgaattcttactaaaactttttattattattattattattttttgagatggagtctaaatctgtggcccaggctggggtgcagtggcgtgatctctgcttactgtaagctccacctcctgggttcacaccattctcctgcctcagcctcccaagtagctgggactacaggtgcccaccaccacacccggctaatttttttgtgtttttagtagagacgcagtttcgtcgtgttggccaggatggtctcaatctcctgacctcgtgatccgcttgccttggcctcccaaagactaaaactttttaaaattgctgacataatattcaattaataattatgtgtagatgcttagttgtgaatttgatatagtccatgttgaagaatttgtttttgctaggaactaatagttttaaacaaatgtagctttaaaaaaaattaaaatgaaattatttctttcttgtagtttttagagtagtgtcaaccacactcacaatcacaaaattccttatatgtcagagaaatattcttttctaacttagtcaattttgaaactaaggagagaggccgggcgcagtggcgggcgcctgtagtcccagctactcgggaggctgaggcaggagaatggtgtgaacccggaaggcggagcttgcagtgagcggagatcgcgccacagcactccagcctgggcgacaaaatgagactccgtctcaaaaaaaaaaacaaaaaacgaaactaaggagagttacaagtatagtgtatactttatgtactttaagattatgaagaaaatacagttttgttgactctgattgagagtgaaaaaacttaagagaacttcatcatgaaattcacccatcatgagtcttggcagtaccagatacaaaagaactttttatgtaagagaggtgttgcttgttaagtatgctgtatttcattcaaatttgtttatgcaacagcttttgtttcaatggttatacttggcatgcttagtttacatatgtctttttaaaatattaatatgtctaaagttgtaaatatttagttttggtgtgtgaaaagcaattgaattttttctacttcctacttctccaaaatcttataattgtcattattatttttcttacagggagtagaaatttcagattaattaaaacatagctcaactccaggaaaaacagagacataaaaatatttatcttcattctctcctgacattgtttttaattattttcatggtttcaaatctttccaggatattgctactgatttcatcttgctggtcaagaaaagaccatatgccaactaatttatcccaatttcatgaataaaatattcttccagtcagtatttcatttcaagatagggtaatatacagtgggccctttgtatcgctaggttactcatttgtagattgaaaatattgaaaaactaaattgcatctatactgaagatatactgactttttccttgtcattattccctaaataataccatctaacaactatttacataggattttcattgcatttggtatacgtaatctagagataagtatgcaggaggatgtgcataggttaaacacaaatagtaggccattttagatcaatggcttgaacatccgtggattttgttttctgtggagatcctggagccagttccccatggatattgagggatcactgtaatgattcttaatatagtggagaaagcatgggtttagaatttagacaagctcatttcataatgagatccatataagatgtgatcttgaacaagttatgtgtttgaatatcagtccttatttataagccatataattttgcaagtgatttaacatgaatatatacagtcatttattccttaggcaggcaatgttctaggttttgaagattttgtggaacataagtgcactttcattggagttcataacctagcaaagaagacaggtactcattacagctttacacaaaatagtgaacaaatcacactattgttcttctgtaggaggtaaacaatgttacatgtacacatagaacaacgggccacaatccatctagaggttacagaaggcattttgaaatttttgaggttttatactgaaatttaaaactatttaaaagcacctcacaaaaaataagtgagtcaaccattagggatatgtgtctaatggtaaaatttcagactctgtgttacttgaactggagagctatttgggaacaggtagaattccactctgagtccactgatgatgatattctctacataacaagtagattttctgctgctggtctttgagaatttagatagtattttaattgtttttaaacagaacccagatattctttatattttacatagtgtctgtggctaaaatgcatacagccacacatggatacacaaacaagacagaaaccaaatttgtgattattcaagaacattgattagaaaggaggatcttcaaaattgacatattcccattatcttagcaattttcaatagtgctgcagtaaacgtggggatgcaagtgtctctttgataaaatttcctttcttttggatagatatccagaggtaggattcctgtgccaaatggtagatctatatgcagcttcttgaggaaacttcatgctgctctccacagtaactgtactagtttgaattcccttcaacagtgtatgagttcccattctccacattctcactagcatttgctatcttttatctttgtgataataggcattctaatcgggatgagatgatatcctgtggttttgattgcatttccctgatgaatagtgatgttgaacattttctcataaatctgttggttatttgtagcttttttgagaaatggctaatcagagcatttgcacatttttaattgaattatttgcagtttttttgctattgtattgagttccttgtatattttggatattaattccttgttggatgaaagatttgcaaatattttctcccattttgtaggtggtcttttcactgtgttgttgattccttggctttttttagtttgacagaatcccatttgtctgtttttgcttttggtgcctaagtgttcatcaatagatgacggacaatgcaaatgtggtgtacatacacattggaatactattcagccacagaaaaaaatgaaatcctgtcattcgagacaacatggatgagctgggaagacattaaagtaagtgaaataagccaggaaaagaaaagttaataccacatgttctcactcatatgcagaagctaaaaaaagttgatttcatagaagtagagtaaaatagagtagaatagtggttactagaggttgtgaaggacagagggagggaaggaaaaggacagttttattaaaggatgcaaaattacaactaaatagaaagaacaagttctagtgttctatattactataggatgactatagttaacaataatttattatatactttcaaactgctaaaggagagggttttgaatattcgcaacacaaagaaactgtaagtgaggtgatggacatgctgattaccctgatttgatcactatgcactgtatgtatcaaaacatcactatgtatctgataaatttgtacagtttattacctgtcaattaaaaaaggacatattccttcaaatatattaacacaatattataattgaatatttacttgacaaacttttgaggtaaggctaagttactttctttgaagagaagcttgttaattagagttttatctagatttttcttcataaacagtacttggtatgcattttctatgtcatatttccattttcaggtttttaaaagtacaataatacttaacattcctttttttaaaaaattattttaggttcagggatccatgtgcaggtttgttttataggtaaattgtatgtcattggggtttggtgtatagattatttcatcacccaagtgagacgcatagtacccaatagtcagttttttcatcctcaccctcctcccactgtccaccttcaaatattccctggtgtctgttattttctttgtgtccacgtgtattcaatgtttatctccaacttataaacaagaacatatggtatttggttttctgttcctacgttactttgcttaggataatggcctccagttccatctatgttgctgtgaaaaacatgatctcactcttttttatggctgcatagtattccatggtatatatgtaccacattttccttacgcaatccatcattggtgggcatctaggtttatgctatgtctttgctaatgataatagggctgcaatgaacatacacatgcgtctgtttttatggtagaaaattaatattcctttgagtatatagtcagtaataggattgttgggtgaaatggtagtcctgttttaagttatttgagaaatctccaaactactttccacagaggctgaactaatttgcattcccaccagcagtgtataagcattcccttttcttcacaacttcttcagcatcgttattctttgagtttttaataataaccatctggctgatgtgagagaatatctcatggtggttttgatatgcatttcctaatgattagtgatggggagtatattttcttattttattttattttattattattatactttaagttttagggtacatgtgcacaatgtgcaggttagttacatatgtatacatgtgccatgctggtgtgctgcacacattaactcgtcatttagcattaggtatatctcctaatgctatccctcccccctcctcccaccccacaacagtccccagagtgtaatgttccccttcctgtgtccatgtgttctcattgttcaattcccacctatgagtgagaacatgcggtgtttggttttttgtccttgcgatagtttactgagaatgaagatttccaatttcatccatgtccctacaaaggacacgaactcatcattttttatggctgcatagtattccatggtgtatatgtgccacattttcttaatccagtctatcattgttggatatttgggttggttccaagtctttgctattgtgaatagtgccgcaataaacatacgtgtgcatgtgtctttatagcagcatgatttataatcctttgggtatataaccagtaatggaatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcacaaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggtttttttctagggtttttatggttttaggtctaacgtttaaatctttaatccatcttgaattaatttttgtataaggtgtaaggaagggatccagtttcagctttctacatatggctagccagttttcccagccccatttattaaatagggaatcctttccccattgcttgtttttgtcaggtttgtcaaagatcagatagttgtagatatgcggcgttatttctgagggctctgttctgttccattgatctatatctttgttttggtaccagtaccatgctgttttggttactgtagccttgtagtatagtttgaagtcaggtagtgtgatgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggccgtatggccattttcacgatattgattcttcctacccatgagcatggaatgttcttccatttctttgtatcctcttttatttcattgagcagtggtttgtagttcttcttgaagaggtccttcacgtccttagtaagttggattcttaggtattttattctctttgaagcaattgtgaataggagttcactcatgatttggctctctgtttgtctgttgttggtgtataagaatgcttgtgatttttgtacattgattttgtatcctgagattttgctgaagttgcttatcagcttaaggagattttgggctgagatgatggggttttctagatatacaatcatgtcatctgcaaacagggacaatttgacttcctcttttcgtaatcgaataccctttatttccttctcctgcctaattgccctggccagaacttccaacactatgttgaataggagtggtgagagagggcatccctgtcttgtgccagttttcaaagggaatgcttccagtttttccccattcagaatgatattggctgtgggtttgtcatagatagctcttattattttgagatacgtcccatcaatacctaatttattgagagtttttagcatgaagagttgttgaattttgtcaaaggcttttcctgcatctattgagatagtcatgtggtttttgtctttggttctgtttatatgctggattacatttattgatttgcaaatattgaaccagccttgcatcccagggatgaagcccacttgatcatgctggataagctttttgatgtgctgctggatttggtttgccagtattttattgaggatttttgcatcaatgttcatcagggatatcagtctaaaattctcttttttggttgtgtctctgcccagctttggcatcaggatgatgctggcctcataaaatgagttagggaggagtccccctttttctattgattggaatagtttcagaaggaatggtaccagttcctccttgtacctctggtagaattcagctgtgaatccatctggtcttggactctttttggttggtaagctgttgattattgccacaatttcagagcctgttattagtctattcagagattcaacttcttcctggtttagtcttgggagggtgtatgtgtcgaggagtttatccatttcttctagattttctagtttatttgcatagaggtgtttgaagtattctctgatggtagtttgtatttctgtgggatcggtgctgatatcccctttatcattttttattgcgtctattttattcttctctcttttcttctttattagtcttgctagcggtctatcaattttgttgatcctttcaaaaaaccagctcctggattcattaattttttgaagcgtttttttgtgtctctatttccttcagttctgctctgattttagttatttttcgccgtctgctagcttttgaatgtgtttgctcttgcttttctaattcttttcattgtgatgttacggtgtcaattttggatctttcctgctttctgttgtgggcatttagtgctataaatttccctctacacactgctttgaatgtgtcccacagattctggtatgttgtgtctttgttcttgttggtttcaaagaacatctttatttctgccttcattttgcttctggccatgtgtatgtcttgttttgagaagtgtctgttcatgccctctgtccacttttcaatggggttgtttgtttttcacttgttgttgtgattagtttccttatagattatgcatattagactgttgtaggatgcagaatttgcaaatattttcttccattctgtaggttgtctatttactctgttgatggtttcttttgctctgcagaagccttttaatttaattaggtcatatttgtcaatttttgtttttgttgtagttacttttggcatctgcatcttgaaatctttgccatatcctacatccattcctaggttactttccagggcttttatagttttaagttttacattgaagtctttagtccctcttgagttgatttatgtatatggcgtaaggaaggagtccagctcctatcttctgcatatgggcagccagttatttcagcatcatttattgaataggaagttcttttcccattgcttgttttcttgactttgttgaaatcagatggttgtaggtgtgtagttttatttctgcactctccattctattccattggtttgtgtttctattttgtaccagtaccatgctcttttggttattgtagccttgaagtatagtttgaatttgagtaacatgatgtcttcagcttttttgttttgttttgttttgttttttttgcttattattgttttggctctttgggctcttttttgtcttcaaataatttttttctaattctgtgaagaaagttattggaattttagtaggaatagtatttaatctgtaaattgctttgtgcagtatggccattttgacagcatcaattcttcctattcatgagcatgggatatttttctagttgtgatgtctctgatttctttcagcagtgttttgtaaatctcattgtagagaaatttcgctttcctggttagctgtattcctaggtattttattatttttgtgactattgtgagtgagatcgcattctgaatttggctttcagcttggacattactggcatatagaaatcctactgatttttatacattgattttgtatcctgaaactttgacaaagttgtttatcagatctggaagcttttgggtaattactgtggggttttctaggtatagaatcatatcatctgcaaacaaaaatagtttgacttactctcttcctatttggatgccttttatttctttctcttgcctgattgctttagctaggacttccagtatgtattagtctattcgtacactgctataaataactacctgggactggttaatctatgaagaaaagaatttaattgactaacagttctgcaggcttaacaggaagcatgaatgggaggcctaaggaaacttacaatcatggtggaaggagaaggggaagtaagaatcttcttcacatagagggaggagagcaaggagaggaattgtcacacagttttaaataatcagatctcatgagaactcactcactatcatgagaataacatggggggaatccacctccatgatccaatcacttcccaccaagtccctctcccaaaattgggaattataattcaacatgagatttgggtggggacacagaactaaccatttcacagtactatgttgaataggaatagtgagggttggccatcctcatcttgttccagttctcaagagcagtgactccagcttttgctcattcaatgatgttgactgcagatttgtcagagatggctcttctcattttgaggtactttccttcaatgcctagtttgttgaggatttttaacatgaaggatgttgaattctatcaaaagtattttctgcatctcttgagatgatcgtgtgtttctgtttttagttttctttatgtgatatgaatgcagaatccttcttgcattctcatgagttttgcaaacttttctgattgacttactttaactttgataacattgtgtttgacaactcacctttattatgtccacccaaatattcacagattgtatagactcaattctatattttagcaaggaatttcaataatatgtatatctgaaaatcattatataatcacaatagcaattcatactgccataaacaggtttggagacaaacagagctgattaactcttgttcctaaattaaagttttatgattggcaagagcagaacacataggaaatatgttgcctgctggtaatgagcaactgaagctccagggtgcccagcaagacaattaagagactttccagtctaaattaaaagaattacagaatgtaaaattttattctcaaggaagggaatgcagttaatgtccactaaagtaagttttcttgaatgcccttttatattttcatcttctaaatatctttaccttttataaattctcaagactatcctaagttgccaaaacaaagtgtaacttgggcaacatgaaagaataaggtatggaccttttccccatcctttattagcattctggaaggaatattggcaacatagacagatagatatgtagatagatagataaaagaaaatagattgaaagattctcacacatgtatgatatttaaaggtcaattttataaagtaaggtgtctttaaatacttctttaattatgttatatttaataactagaattaattgctttcactttttttaaaagtttaggagtaacttatctcaaacattattttaaaggttaaaataacataaatgcggaatcaaggttttttgtttttttgttttttttgttttgttttgttggctgggctggagtggagtggcatgatcttggctcactgaaacctctgcttcctaggttcaagcaattctcctgccttagcctcctaagtagctgggattacaggcacctgcaaacatgcccagctaattttcatatttttagtagagacggggttttaccatgttggccaggttggtctcgaactcctgacctcaagtgatctgcccacctaagccgcccaaagtgctgggattacaggcatgaaccaccatgcctggctagaaatcaagatttttaacaagagcgaatcactaagtgttgtaagaatgaaatgagaaaatgtgtaaaatattttgtgttaacatcacataattttttggtaagcgttagtttccttgcctttgccgtgagcatttccccaagctatattttgaatgatgagtcagtgtccatttcattgatcacattctacctgtgtaggtcttttgctggcaacaagagatattccaagttttgatgaggtagccaccaacgtgggtcacacaaattctaccttgcatagttttctctctttaaataattaggccagcatcatttactaactaaatagaactctgttcaagaggcattgaagaaagatagagcaattattttattttgaaaataacagcaacaaatgaacagaatactgttatttattagacttgacatgctgagtaaaatcaagttgctgttaggggaatgaagagatattacaaagtacaagacagtttatgttctggtatttcagaaggcaggtcaaaggttgatgttgtaagaataatttatatttgccattctttgcaataatttcacatggaactgggattgaatttgatgttgtgtaaaaaacaatattgagagtgaagaaggtggtaaacgtattttcaatgctataaagatgatactgtacaaaaagcaagatttattttgtaacaaaacattcatgaagggaaaaacccccacaaaactttcggtaaaatttacaactgaataaaacaataacaacaaaaatgatttagtatcttctttctttgtgattttcttgaacctaaaatattttatatgcttttgttccatttatagaagctttgttaaaatcctactatgtccagctcctttgctgagttatttgtggggggattttagtcatacagtggcctgaacaaatttgcttgattttgagtatatccaatacattgctcaaggaaccttacactaaaacaactgtggtttacttttggagtctgaaggaaactttgaagaggccagagacccaggaatttgcagatgtgagatgaccctgtctggagcaatcttagcatcacttctgtgtatgtatatagtctaggtggaaaaggcgggtaggcagggagtaggaagcataattgacttaaggaaattccattattgaatataaagggactctactctgatttctgggtccagccctgtggggcaccaccatttccattgacaacagagacactttccactcctgggtatggagcatcccacattccttttctggaagttcataggaagccaattcatggcataccacaggaatcaaaagaaagatctctcccttgaactttgactatctttcttaccaaaagacaggacagcctgactctcttgtccactgacataaataggcaaatatttaaatgtacaaggatacaattaatacctaattcatgagaattttttagcagatgcaattcatattcactttcaagtttcttcaatcttaagttctgtcatcctgcagaaaatcacattaccaaaaacatgccaggagtctaagtccagcacctcaatggagagtataaaacatggaggaatcatagtggggaaaattggtaaaactgcaccaattttctagttagatcaagagttctcaaattatgttctgcagcatttagcaaatgttcatatgatattagttagaattgttctcaaacttaatgaatagaataccctactataattccttaaataactgagccattgagtggtctcattcaacaggaagtccaggtgttatcaggaagggggagatcctcggttcttggtcttacttgggagacagatttctactaagtgacaattcaaagatatcagtgagccctattgaagggaaattgagaacagagagtttacatagagagacaggatactctgaaaggtgaggcagagtgggctactgaaagccagtgtgccggcaacagccctgagagtctgcatgggctttttataatgttggattgttctggaagttcccacctttgtcttaagtcaccacctttttctttctctagttttcccacttctgtcttaagtacccacctttccccatctagtttctgcccaggcttgtggaattctctcttactctctgttgatacgcatgtgcaaaccaggaattggatatgaattctatctaatggctgtgtttttcactccaggaaggttgtgtagtggttaaacctgtacttactgctcctgcgtatctcttagggatttctcctctgccctcttcccttatcatcatgcatctagtgacattctggcaggttaactgcagagtgagggattactgcaagtcataagggacattgctttccatctaggtgttttccctcctctctcctcatatctagcatggatgctttgagtggtctctggggtgtgagattttccagccctcccttttctcaggggcttccccttctgctcatgtctggctatcagcctactctaacacaggtgcaggcaggactctcatcagtgaccatcatcagccttcctggaaggctcaggcatccttggtgagcaacacttgtgatttcatttgcaactgtagtagttagtctttctgagctcagacaagccatttgtctttcagcttttggtctctataaccctgaaccctcttagcactcctgcagatgcacaaagcctggaagagcaaggggctaaagctttaggaaccaacaccaactgctcgagatgaagctttttgtcctttaaatccaggtaaacatatttagtatattttttggtaaatatatttagtacacattgtaacattttctggtcacactgtcttgcagttactactcattaatactactgtagtgcaaaaacagccatagacaatacaaaagtgaatgaatgtggtcatgttccaattaaaattttatgtacaaaaattggcccctggctaaattgggccaatggggagggttgccatatttagcatataaaaatataggatgcttacattggaatttcaaataacaattaacttctttaatctaggtatgtcctaaacaattatttgttatttctatgaaattcaaacttaaccaggtatcatttatttaactttcaactctacctgcaagttgtaatgtgatgacttctggtttagacagattttctgaggaggaattcattatgattatccagatcccaggaagatttacaactctactcattgcaacatcaatgcctatgagtgttagtgtatttttgttgtcatcgccttactctcctagctccctcacacttgcttcctgaggtcacctactgtactttcctgctatggactaaattgtctctccccaaaactcatatgttgaagctctacccccccaatataatggtatttggagatggaggactctaaggaggtagtttacgttgaaggacgtcataaggtgggggtcttaattgaatatgaatagtgtccttatacgaagaggcaccagaaagtatatcctctctctgtctctttctctctctctctctttccctcttcttctcattcttcttgcacctacagaagaaaaccatgtgaggtcacagtgagaagggaggaagagagccctcaccagaaatccaactgctagaaacgaggttaggcttccagcctccagaaatatgagaaaataagtttctgttgtttaagccaccaagtctatgatattttattatggcagcgcaagaagagcaatatacccctccattaaaactcttattaaagagagaaaatgattactacaagtggaactgcatcagtatttaccaaggcccagtggagggcatatatctcagctccaagcaaaatcctaggaaactgaaattatgagtgacaaatgggacatggagaataactctgtggccaaataacaggagttgaaatggaaagtaaggaaaagaaagtatcagaagaaaaaagggactatggaaaaaagaaagtttccactttcagagttaaaaaactcacaaaggaagatataacaaaaataatactttaggccaaaaaaatagccacaatataagtaactttatggcataaatctgaaaaggtgaatgaattattttaagaaaattatattttatcaaacttgaaaatttagtagtactggaaaaatggtctgatagaaaagacaagtgttaatcttcagaaaacacatgatttttttcatcatccaaagaatttgagatgacagaaaagatagttggcatatattttatttcagaatattattaagatatgactaaaactaaatttgcattaagaacatagatgtaatcaccctaattataattttagttaattaaatctaaagtcataccaaaagaataatgtaggaaaccaggtaggtatgatttcaggcatacgtggatgactttacactaaacatattaaaatagagaaaaaagaataaagataaccttctgatttgaaggttcatatggtagcataaactgaagcaatacagcaattggatctaagaatgcaggtgtaaaaaccttaattaaaaaactagttaataaaatcaagaggtatatcaaaacagttatgcagcatacacaagtatttagttctttctttttttttttttttttttttttttgagacagattcttgctctgtcacccaggctggagtgcagtggcacaatctcagctcactgcaacctctatctcccaggttcaagagagtcttctgcctcaggcttccgagtagctgggattacaggcccctgccaccacacttggctaatttttgtatttttagtagagatggggtttcgccatgttggccaggctggtctcaagtgatccacctgcttcggcctcctaaagtgctgggattacaggcatgagccactgcatctggcccaaatatttaattctaaatatgcatggatgttaaatagggaatcctttccccatttcttgtttttgtcaggtttgtcaaaaatcagatagttgtaaatgtggggtattatttctgagggctctattctgttccattggtctatatctctgtttcggtaccagtaccatgctgttttggttactgtagccctgtagtatagtttgaagtcaggtagcatgatgcctccagctttgttcttttggcttaggattgattttgacttggcaatgtgggctcttttttggttccatatgaattttaaagtagtttttttccaattctgtgaagaaagtcattgctagcttgatggggatggcattgaatctataaattaccttgggcagtatggccattttcaggatattgattcttcctatccatgagcatggaaaattcttccatttgtttgtgtctgcttttattttgttgagcagtggtctgtagttctccttgaagaggtccttcacatcccttgtaagttggattcctaggtattttattctctttgaagcaattgtgaatgggagttcactcatgtcttttattggtttataagaatgcttgtgatttttgcacattgattttgtatcctgagactttgctgaagttgcttatcagcttaaggagattttgggctgagacgatggggttttctagatatacaatcatgtcatctgcaaacagggacaatttgacttccttttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgcaattggctgtgggtttgtcataaatagcttttattattttgagatatgttccatcaatacctaatttatttagagtttttagcctgaaggactgttgaattttaaatgattagttaatgggtgcagcacaccaacatggcacatgtatatacatatgtaacaaacctgcacgttgtgcacatgtaccctagaacttaaagtataataaaaatatacaaataaataaataaataaataaataaataaatatgcatggatgtctcaacttcacataaattatcatagaaaaaatctaatcacaaaacgacgtttgacaagattatgtgatctttactgcttttaaagactaataatctaggaatagattgagaatattcgacataataactaacaattcacccacaaataatgtgaataatactatatcacataagagacactcatttactttgatttatattattgcatgcctagaaaatcaaaggtgcaactaaaaagcagttggaattattttagacaatttgatatggtaattatctaaaaaataaatacttaaaaccagtagattttctttatattagtaataagcagtaaaagaatgtatctcattgctaatagtgacaaacatgcaataacttcttaaaaagaaggaaatcctgctatctgtgacaatatggatgaacctggaggacattgtgctaaatgaaataaacctgattgagaaaaacaaatgctgtacaatatcacttatttgagaaattttaaaaagtcaaacccatagaagcagcatgtcagaaggtagttggcctgagactgagggaaaggaaactggggaaatgttggccaaagggtataaagtttcagttttaagatgaacaaagccgggcgcagtggctcacacctgtaatcctagcactttgggaggcccaggcaggtggatcacgaggtcaagagactgagaccatcctggccagcatggtgaaaccccgtctctactaaaaatataaaaattagctgggcgtagatgtgcacgcctgtagtcccagctactctggaggctgaggcaggagaatcacttgaacccaggaggcagaggttgcaatgagccgagatcgtgccaatgcactacagcctggtgacagagtgagactccatctctaaaaaagaaaaaaaatatatgaacaagttctgggggatataatgtacagcaggagtggtgtagcaattagtttgattgtgattattataacacaatgtttgcatatatcaaatcatcatgttggacaccttgaatatatatgacatgtacttgtcaattaaatatgttaaaattcaagaatagatttgccatgaaaaatgaaaacatgaaaaaataaatactttagaaagtgaatttaattggaaatatattgggtttataatgaaagtccatgtctgaggtcatggatttaaagtgcaaccagtcagcttactttctgatattgtcttgcaaaattcaggtgttaagactggagagaatggtgattaaattctactaaggatgtggttttacagtgtgagtgagagggttaagatgcttggccgggtgccatggctcatgcctgtaatcccagcactttgggaggccgaggtgggtggatcacctgaggtcaggagttcaagatcagcctggctaacatggtgaaaccccgtctctacaaaaatacaaaaattagccgagcatcatgtctggtgcctgtaatctcagctactggggtggctaggtgggagaattgctggaggaaccctggaggcagagtttgcaatgagccaagatcttgccattgcactccagcctgggtgacagagcgagactctgtctcaaaaaaaaaaaaaaaaaaaacgagatggttgaaggcctttgtaggaaagttgctatgatactctgcagttaaggagacaagtgatgacaaatgagtgctgagaggtggaaggaaattgtcgtgctctgtgtgtgtgtctagaactttattgtttacattgcattttattgtttacattacattaagtcaatgacccatttagagatcatttttttgcaaggtatgacgtttagcttaagacttattttattttgcttataaatgtccaactactccttcatcattcattgaaaagtaccacccaccgccccccaacccccagtggagagaattttgttttaaagtaaataaaatgtcagtcatacactacagcagtcccaaggtcatgtcaggtttgccactgtgcagctgaagcagccctccccagcatcatacacacagtcacagcaccatgagcgtaacttgagtgtttgttatgctcaaggcactttttgaagatctttcatatgtctttctttttatttaattctttataaaatgtgcaccatttttatttccaggttacataaaagaaaatacgctataggcagacatcagtgacttccaacagttaaattgttattaagtggtcaaatttagggtgtcggattccagaccccatgccctgaaacataactaacaccatctaacattaaacactttccaaatgcctttttttctacttaatgtaatacttacaatgattctgtgaagtaggattttactccaaaatcaatttcagcataaaatttgtctttcttgatttttctcagcactggcttttccccaactccactcttaggtcttttatttctatgatttttacccaccctttgatttacgttgcttataatttttaggaatccttgactctgtgttggaatggactttaaaaccacataagataaaattctcacccacttctccatcctcagtcattgcgtacctaattcgtattcgttcatttataagaattttgaatatacaccttcttcatatgcacaaagcatgcccattggatgcaggcctacgtgaagttttataattttaaaacctggcctatttctttctcttgttagtcaggttaggttgttggtgtgccagaaatgtctattttagactcattttccatgagcattttgcttgaggagtgcaggggctgctgctcctatttgcctgttgatgcagaagccatattccaataacttctgagctctatgctattcactctgcaaatttacttatgactctacctgaccatggcatcagcagaatgaccttcagaactgcaaaggagtcaaaaaacatcctggcattttaagttaagtggaaaactttatatttaacttacagaataccaaagcttctgagtacttagattttttaatgctaggactcattttctcagtggagaatgaggcatgaaacaacatgacgaagattatatttgataattttaacatcacggtttacattttaagacaattttaataatactggaactaacatattccgttctttctgcttgaaaaagttctaatcactcagctgaatgtgaatcatcatttgtctttgttttacatatgcctgaaaatattcaaatgccttttagacatcttttccagagtgtgtgcacacaatttggacttgtcatgctgtaaaaaagcacttaagaacagatgtaatttactataattttagagtccagcatatcaaaaaataaacaggctatgcttgtttatccggtatgatcaaaatgcgtgtgattcttcacattctggaaaaataaacaagaaagaattgtccttatctaagattgattcctgacatcagtatacaatatgtttttctttttcttataaagaacataaaatgtttagggtctaattcacacacagggaaatgccaatatttcagataaagctgatcaataatcatggaggaggaaggtagggcatggcaccagtcctcatgcctctcagcaaaattgttttcgctccattgctgtctgagtcttacaatttagttatttttaagtgattttttaatcacagaattagctctcactatatttcagtgagtagcgaagtctctctcctggtcactgagtttacttattctctctgttaccactagactgtagataagcatgtactagcaactgaaaagtcccaggaactaggaggaagccaacatttcctctattcatttatattttcttctttaatattaatattaggtctgaagttaggttatgtttggttttgcttcacaatctaattagtgtggtgagatttgtgactagcagagctgaagtgtgctgagttccctgtaacctggtaaaagctatgtgaagttggccctggggaagggaaagatgctgaccactgcagaagactgagcaccctcctgttcttaggttgcattttacagaaagcacctacttgcttctctattttccaaatgtatgatttatgaacaatctatttgataataaaaaataaggctgcataccagccacttgggaatatgatttgtttattaaccttaaatttcctagttgttaaggcattggaagtgtttgacccactaagagtccattctcaacaggcttcaacccaaagagtagaaaccatgcttcatgactggagaagacactacaactccaagaagcaacagttcatttttccccttcaggttttaaaaaaaaattacatgtaccatgattttcaatattttatttcaaataaatatgttggaaatgataagaaaatgaactaagatttattaactgctaagtgttgttctcagtgctttacacattttacatatgtagattactcacacaatctttgagtgtccctatgaggtagataatatcatcagctctactttacatataaggaaatagaagcaaagaggatgttagttattgactctggacacatagctaacacgtggccaagccaatcatgtgaggagttcaccgaaaggctcagctcttctctccattccctgtggaccccaaagaatcctgagaattttgaaagaaaaatcaagagcctatgagttgaaaacaaagtattattttcttttatttttcctttatagtttataaaattaaagtgtattcttaaattccacattgtttttcaaataacaaaattaccagctttttatcattctaaagaattatatatagattaatattaaaaccatgctcagtcagaatccaaaaattaatttctttaaattaaaagacttggaggtagagtaatgggatctagaacttctttgtattagacttagcagagacagatgcctgttttctgcttgagtgatgaaattctacttctaactacctcaagaaaatacggcaggatgcactggctcacagaaactaatgaagctttggccctccaaactgctgtggtggaggcacacagctggtgctcagaaactacatggaagcaaaacaaacaaacaaacaaacaaaacacctctggaagtaattttatgttaactatttctgattttcttttttcagtgtgccctcttctttctctcactgcctttctctatatggtaaaaaattatatagccagcgaagtgcccacttttatattttatcactgatcactgccaccacagagagaaggctaattctcttttcagtggccatttaaacaatttcaggaacacactctggttgacatggccgggaaatggcctccttggattaatcaagtaccttcagaggcaacttgtgctcagaggagtcctatggctgaggcttgttcccaggattcctataggggagtgaggctggcatgcagctgaacacacttgacccaagaaaagttatgttgcaattcaccaagaaacaaaatgatgtgatggcaaggacatggaatttaagtgttaaagaaatagtaattcaacaaatcctggttcaactaattacaactaattaattaatttatataaattgtgataatttttacattattatgaaaattagatgagataataggtaaacagataatagctagcattgagctagctagctattattttttatcaaaacccttgtattgattcagtttgtaattttacaatgtaaggacaattactatacccctatcagatgagaaactgaggcatagggaaattaaagaagttgttcaaaaactcatatctagtaaatttaggagccagaattaatacgctagaataatacaagcatgcttgctgttacaggaaagtgcaatactcaggatatgcattacatacttctttgaattggattcagaattgctaagattataaaaatatccctcattctttattaacaattacttatcatcagttttgttcatgataatttagtttcttgccttgagaagcacagtagaagatgaagatgaaaccagtcttcctgagttaaaaatgtagctttgccatttaccttggacacattgcataacatctgtcttgttatttttgttttctccccctctagcaaaaatgttaatagtagtagtaactacctttttgggttattgtaaggaaacaattaatgaattaatacttgtaagcactctgaataatgcctgacccttagaaaacacttaagaaaaagttagatcttagtatactagctattactagctattactgtcactactatcatcactaccaccaccactactgaaactaccagtgttactacgatcacgactactgccactaatactaccaatattactaccatcaccaccaccaccactaccataactactactatccctactagtactactactaccaccaccaccctactgaaactattaactattactaccattactactgccactaacactatccaacattactgcaatcaccaatactgccatcaccaatactgctaccatgataactactactactaccactactagtaccactactaccaccacaaactactactcattattactgccatctttatactaccatcacctctgtcactaccaacctcaccaccactattaccgctgttatcaccaccaacgctactaatagtattgcaatgaggtttcttctcctgaacccacaatttttaggtgatcacattttaatgtccacattctgtttttatttttgggcctcatatttcacttaatcaaaaattatgtaccaagttcttaatttgtaagaaactggtagagaaattatatggtagatattaaatgaacaagtcatgtagccgtggaatgagtgcagttttgcaggacaactgatcctctctacatgtctggttgccataacttcgcataaacgtatcgtaggacaatctgacttataggaaacactgagctgcttttgctccccatatttcattatcatatcaagacactgaaaggaaaatatttatttattagatttatttttatttaagaatattaaaatgtcttcattagtattgaaaataaatgcacacttgccatacacaaaaaactagtctctcaagaccattattttttatacgtaagtgcctctgaatataacaacagcattgtcagagttaaaatttattgaactggatgcttgaagactaattttggcctctgacttggctatttctgtgaacttagacaagttaaaatttctgagttttggtttccatatctgtaaaacaaagcacttttaactagatgggctcaaaggcctcttggagttctggtgttcctacctagttctatgtgcactgctcagaaaccctgtacattctggaatgtttaacctcagatatttatcagtgcatacaaaattttatgtacaaaaataaaaataatgttacaggtacctgctagaaaaaaaatgttgatgtgctttggaagattatagagtctgttaggtgagaagtaacatgattcactcaaataagtattaatacaaactaactttagtggtattgtgccagtattttagaataattagaaactgaaactagtgacagagaaggagaatttgttgaggatttaaaccaatgtgttacaactgtaccaaaaaaatagaatgaattttaaatcatgaaaataagccaaacttggtggctcacacctgcagtcccagttactcgggaggctaaggttggaggattgttggagcccaggacttcaaggcctcattgagttatgatagcaccactgcactccagcctgggtgaaataacgcaatgtttaagcttgaaactaaattggagaagagaataaatgcaataaggcaataatatacactttaaatacaaatcttaagttttctggataggaaaatttttagtaatagtgcattttggtggtaaaaattctgggactgggaaaaaacccaagtgaaattgtttttaggctggcttgcctgtgctggcctctcacctgctcctcagcaccatgtccaaccctcgatgccccctgccttggtttagggacccccagtgtcctctgccatacagatacacacacaccttgtaagttgtgcccatggttgtgtgggatagtgtttctcagcctctgtaggccacgctgcctttgaataaatgtaaaaatattcaaggcatccttggtaacttgtgccttacctcgttttgcaaagcaaatagtaaaatgggtaaataactactcccttattcccagcagaagacttcacttttcttatgcacttggagaggggatgcagctgggagaagtagtgaaagtgagggagtgaggtccctttcaggagttacagtagatttgcgaggcctggaatgcaggaagagggcaggctgagcactgcacaagaagtaggtcaaaaaaaagctgtgactgcactcagccctttggacctcatcttcaaggctattagagcctgaagaatgttgaggaggaggatgacattgaggctcgtagctcatattttagaaagagcatttgggctgcaatgtcaataactaattaaaggaggtgaggcggtagctcaggagcagtgggaagatggttggcagcataaggaggcactgtgacttcaatagaggcaggaggatagtaatggggacaagaggatgcatttaaaataactgatgatgagttgaaggaggataggagtagcacagagaagaaattcaagagatataccagctaaaataccctaacagtagttctcctcatagaaaaccaaattgtatgagctctcacaggaagaatgcaccaaaccaatagagagaaaaacctgattgctttgcatataaaatgggaatggaaatacatttatttaacaaatatttacatagaggcttttatgtgctaaacacaaacactctgtggattcagggggctcataacttctagcatactgtgacagattcagaaactaagcggaagcccgtggcagaccaggtcatcaatactgcaggtgagagtaggtcaccagagtacaaaatcttagatgcatttgagacatctaagatttcatactccacatgcctttgcaaagtcctaagactcacttcaaacctgatttgtcagtttttattgaagcattgcagaatgtacataaatacagactagtggctgatggtaattattgtaccgctcagtgctccaacacacaattacatcggtgcataaaagcatagatatttaaactgccagacagttaatttgagaaaatgaatgcttttgctggtttcagtgttcctgaaaggagaatggagaatactgcacaggtcttatgtgaattcctaatgatcggtagataaaccagttgcacaagagcaagcaaatgattcagttacactcagctaaaattatagttttattcactgctgccaaaaatataaagagatcaggcatttagaacatctttacattaagaaagcaagagtatggtttttttcttatatgcattataaaagatgaaatatcaatttgctaagagatgcctattatatgtcattaattctcataatttccaaacaaaaaccctctttcagaataaaatctggtcttcatgtatatgcaaagcacagattcttttattttgtttttcctactgggaaagggtgacattgtagaggccaaaagaagggacatcttcaagcaaaccagtcctgtgtgacaaatagctgtgtaacctacaggtagcagctaaaaatgcacacaagccaacacatctttgctttcttaagtgatgtgcccaagtccatacaggtagtaagtagcagggcttggagtcaaacgtagacatcccatttcccaaggtgactttgcttttaacaaaattgaatataaataatatagggttttcagtgtctttttcttattattagaacaacaactaaaacaacaaaatccttcagtcaggatctgaactgtgtctccctcagattaatatgttaaattcttaacttccggtacctcagaatctgtacttggagatggtgtcttggaagagctaactaaattaaaacgaggccattaggatggtccctaatccaatatgccttgtgtccttattaaaagaggaggttaggacagagacagattcacagagaagaccatgtgaagacacagggagaaaatggccatttgcaagcccgtgagaaaggctttgggagaaaccaacccgctgacacatcagcctcagagttccagcctctagaatgtcgagaaaacaaatttcagttgtttaagtcacccagtatctgctactgttttatggcaggcctagcaaactaaaacaccttcttagcatgtgaatagtattgctgctaaaggatagatgtaatgaatcattgttcagaaattttttaatagactgtgtaaaatagtatttgtctgatacttctaaattataaatgttatctttcaaaagattaacgttgcatattaataaagctgacctctaaatataagatgctgaatagcaatacggtcctaattgcatgattgaaatggactttgaagctttacttttaatcctctgcttataaattattgatatagcttcaaattattggtgaataagacagaaaatgatcctgttcccatgccaaattacctccaagggctttccctgcttctgcttgtgctaggcagtgaggaagaaaattgttgccaaattcctaaagaaattggccctagtaattgaagcttgttgctaaaattcgagtgttaagcaaaagacagtatgagagtgggattaaatactccatagaatttttgaaatatttgttgtgttaaagggtttgtaactggattacaaattcttgtgggcaggcagttacttgcactgaacatatgttatcttattttcatggcataccctctcataaatgttactataagatagttacttatctatggataaagccatacctgaaagcactgagatttctgccatcactatacaagagtccagctgctgattattgaaaggcacatttggctttagtccagagttctgtaaaaagattatgtgaatacaaagcaattacagaggttggtttgggtagcaggtggactaggaaagtgagcatatgcatttttaacatcaggaactcagtaatcaatggctcctctaaatgtgaaattaaatcccagctaagaatataagccattatttaaagcaattacaggtgaaattctaaatataactataatcaacacttgtttttctttcctataaacagtatcaagataatgtagtagttattatttttaaaatgcattagctaaattgaagaagatggttaattttgtccaataccatttttgtttgtttctttaaatagacattaggttttctttatttatgagtgtgtcacatggaaatctctcaaatatatgtttaagtaatgcctagtaagtttaaatatgtagtattagaacatgatttttttaataagcacataaaatgtaatttttatatactaaggcaaccattgtaataaatactctactactgaattcacactatgtcctaagaacggtgcgagctctgtggatagaaggaaaagatgcacacttgctttcctggggctcaggtctgctgtgatacaaaggtgtcattgtacagtgacttgtttcctaagtgcttagtatatggtgtgttacgttgctgtattaagatgtgctgggtggcaatcatatgctgtgctaaagaaaatgctgatcgtatggcatgctatgtgcccatcatacagtgtgctcagtgctcctcagagggcatgctaagtgcctgcatatggaatgctatgtgtagagtctgtgcaaggtcagaggcatattactgttggtggaattctggaatatttcatagagaaagcaacataagaagagctgtctctggttgtgtaggtgaacttttcctgccatgctttgaactttatgcatgagtacacaatggctggttctgcggcacccttcttgggtcatcacacctgaggacaagtggccgcacactgagaaaggtgaagtgaaaaagagtcatagaggccagggaaattcagggactccatttatctgcatgactcagtaatgaaaacagtgatgttaagttttgaaagggccacgtgactaaatttctaagaatctcaaaccaggcctttggactcagactggctatttttaattggttgtgccaggctgtgtaggttgtgccaggctgtatagttttatgagactattcacatccataactgatacaggagaagaaataggtttgaatgcaaggaaaagaagctttttcagaatgttttattgtaatgtacataaaattgattaaaataacttagtaaataatggaacaattgtaagaaattagtgtgcatttttttcaaaagtttagtattgatgaaaaaaagatatgcataaacttgagaagatagagatttacaatcaccaacattgggacatgtgttttatatataaagcatatatacatttacatatgtgttttaaatataaattcatatatgtttatatgtttcatatattatatattatatataacacagatcccaatgttggtgatttgtcaagatcatattgtagaggaaggtgtgtgagtcagcattaccagtggagaaacttctggaacaggtgacaatagtatccaggttagacagaaaggcagacaaaacaaaagaaagcccatgagctatatgggccagtaaaggtccaagtctgtattgaaggtgagtaccaggctccacaaagtggtagtgaaggtgagtaccaggttccacaaagtggagaggtacgagctttttcctcaggagcatacaatcttggaggcagcatgcttttacatacatcacagttatatctggggtcatggaagttaaaatggttaagaacctccccagtcagggataaaaatataaagtctcctggtaaataaggacaatggaacggtgaagacagaaaaatgttaggtataatatcagaaattgtgatgtgtcctactgattctttaaaacagaaagtaaaggattcctgagtgaagggggaggagaaatttgctgacgcagagctaggagctgaggctgaggtccactcttcagaccgacacatgaggcctatatgatagaggcactttggaagccatttactgtgacttttagtagtaattaagtggtaccaacattgcattaaaatacatcttaggaatactagagggaatatgaggtcataatgaaggtatggacttacttagcaatagtaaaaacagtgcatcagatttaatcatcttgaatgacttaagcattgggttcagttacaacaggtgctctttttcggtccttttcatcaaaatggttattctggcccaccgcccagtgggtagagggactggaacagaagtctcaagggctttcttggagctggaatccttttagagccaactgcctcaaggcctggcaattttcctgtaataactgcagggaagcctcctggtctagaccgggtttgcacagatagaaacattcaagacatttagtcagttttctgccactcttgttgctagaataatttttaataatgcttcatttcagaatttccaaacaggatatatttccaaagttatctcaacctacaaactctctgaccaaaagtaaacaattaggacatatttccttcagtaaaataaatgttatcttcatttattttcattggtttacaattcagtctgctttgcaagtccaattgttttgtttttctgactgtgtctgcctctgagcagccacacaccactgcattaaacatgccttttaatatcacttctgtattcaataggtggcttttaaatgtatgtatatcgttatcatgcaaaactggttattagattggggagagagtctaaaaaatgtcttttactgcaaacaaatgggaagaatcaaactttaaatcactgaaacttagtagcactgcatattaagtttctaatgtagcactctaattactctccactgaggaatcacaattcacaaatatattggaaaaagaaagattctgtacagagaaactacttgcttatcccaagatcggtacttatgttttaattctatctccctccattactgatggtgaacaggaatgaaaatagagacatagtccaagcataaactaaataaaatgatggttgtgattaagagataagcagagaaatattttgctctttttgagtgtctcacttgtaacaatggttcttgtctttagctagacagagcgtatagaaagagcctgtagaaatttaaaagcaatattactttatacggtaaaagcaatttaaaaagcattcatgcccatagcaaagatgctaaaatttgtaggttctaaaagcagtaataagtacttacattctttcaaaaattcctacacacatgtccagataaataaaccatatattgttcccaatacttcatcctaggttcaaattccaataccgtgacttaaaagtgggatgactttgaacaagttgagctttttgttggttattgtttctcccactttagaataaaaaaaaataattgaaccagcttcatggagtgttgaaaagtaagttaacttaagttcttaccccaattctcagcttgcagttagtttcataaatgttagttctaattataattacaaaaatgtttgaatagaaaattatctatatgctcaccccattatttaaataacacacaatttgaactttatatcaatatatactcataatttggacatacaaattgcatttaagtgtcattttagtgattttgggctatacattcatggctatgtcagtcagaaatgaaatttcagatcatgaaattactttgaaatccagcatgacttagaattgacatgaccagtagcgagagtcagaacatcatttgatgaagataaaattgatgacagacaactgtattctctaaaattgcatatatcttaactgatagcattaaactgatttatttaggcaacaaatatttactgagtgcctactatgtgccaagcactacactagatactaaagacataagaatgaataaattatattaaaggtcttttgtattattgtttatactttaaaagttagtttagcacacacgctgcccgatcattcagagcatcgcatatggcatagaagagaaaagagtggttgagggttttgtttcaaggcttcatagcatccagaaggaaaccttagtgtctactgtccaggtggaatgcagaaggagaggccctcaataaatgggaactgaaactttttggtttaaagccagcaccctcagaggaccccaaatataattcataaaaaacatcagtcttcctacaaaagttgaaaacttgattctcactgtcttggcctgagttgtcagcaaagcacaagctactatgggtaacaattttacctacagagttgccctcacaggatctgtgggtttggattcataccgtcttggtggagaaatggctcagacttgaaacttctcccaattgtgttatggagaaaccatcctcatatcacacattataggttcctcaagattaagaacaaccaaacatgacttcaatctcatagtcaacaattgcaaatacagcaggaaaaagccttctgttttcaaagctcataataaaactaaatacagagtaatttcattttattattttgttgttgttgttgttgaggatcttgctgtgcttcccagactagtctccaacccctgatctcaagcaatcctcttgcctccacctcccaaagtactggatccacaggcgtgagccactgcaccttgagcaaagtaattttaggtgaccagaaattcatataaagagttaatatacttaaggacataaaattcaagtggaaattctgtacaatatcactatggaaaaaatgttcatgtgaatgtgaaaaagaaacaagtggaatgctttgtaaatagcctctaagttaaaactataagtttaaaactctgaggagaattattagattgtcatagcccaaaaaagacatatctttagttacagctataaaatataacaaaataagttatcctgaatgtagaactgaaaagacagaaattgaaaccaagataagttaagggtcaaagaaagcaaaatgggaggttctcacacaaagctaattggagtttcagaaagagaatagtgagagtgagagacaactattttacagatttttcataagtgaggaaacacaaaaatcttcaaatctaggaggcacaaatatcaagaaagagaaatacgaagaaatgtaatatatagctgattttgtagtggattccaaaatgccaaagggaaattgaaaagtgtttaagtagtcagagagaaaaggttatatattttactatcatgataatggaaaccaggagcaaaatataacactttcacaatgctaaaagaatgcaaataccagcttgcctttcctgcgttcacacttttacttataaaaattagaaagaatttttgttttacaaaacctttgaaatttgcgttaaaagatgctcaataaatgcatttctgaaagaggtacttgaggaagaagataaaggatcttgcaagggaagtctgagaatcaaaaattaatactgagcaaaaaattattaaacatttgggtaaacataaataaacactgactacataaaacagaagcaaatttgaagagtaaaaaagtatgggagctccacattattggacaacagtatcatttaggatgggaaataatggtttcaagtaacatttgagctctttgttctgtttagaaagattacaaagatattcattgactgtaaacttgaaattttagaatgtcttcttaatttaacaacagcaaggtataaaaataatatagaccataggaaggagcaaattagaataaaaacagcatgtttaatttcaaaaagagagcatgaaaaacacagagaaaaagcagaacatataaaataagcttccagtggatatagacagtgaaagtttcaaataatgtaaaatatgtgtattataaatcaacacatttatgacagtgtttgctttcagtgtgaaggctagcaaatgcaatcaggaaagcattcacaaagaactgtttcagtaagcattatattttgacctggaataatcaaagtgggcactcgattatttcttgaatttttttgcagcttttttggaggtataattgaaaaataaaaattgtatatattcaaggtgtacaacattaagttttgttatatgtatgcattccacacatatgtgaaatcatgcagtattttttttctgtgtctggtttatttcactcagcagaatgtccttcaggttcatggatgttgctgcaagtgacaggatttacttgtgtattaaggctgaataatattccattgtacatatgtgtacacacacacacagacattttctttgtctatttatttgttgttagatgtctaggttgttttcatatcttggctattgtgaataatgcctcaatgaacatgggagtatgattatctcctcaaaatagtgatttcattttattttgtggatatatactcagaagtgggattgctggatcatatggtagttccatatttaattttttgaggaacctccattctgtttaatttaaatgattgtaccaatttacgtttcccaccaacaaggatgtccctctcttcacatccttcccaacacttgttacctttatatatatacaatatatataaaatagccattcaaacatatgagatgatatcttactgtggttttgatttgcatttctctgataattagtgatgttgagcaccttgttatatacctgttggagattagttgaccacatatgcatgtgcttatttctgggttttctatttcattccatcagtctatttttctgtttctatgctggtactatactgttttgattactgcagctttgtaatataatttgaaatcaaaatgtgatgcctctagctttgttattcttgctcaaaattgcttttgctatttatgggtctattgtcattccatgaaagtcttagaattactttctctatttctgtgaaaaagtcatataattttttaatcatcattaaaatatattcaccatatcccaacatccctcaagtaaccattgcagcatcaactctaagtctgaaatcttatctatatatcatcaaattgaaacatcctaaattttatcatttaaattatttatgggtgagattcagggtacagtagatcctgtgacaaaacctctccacctgtggacctgtgaaaacaccaaacaagttatctgcttccaagttacaataattagactgagacaggcagaatatagacattctcattccaaagggagaaactggaagaaaaaaagaattacaggtcccaggcaagtctgaaatccaacagggaaaattctattaggtttcaaggactactaataattctttgtatcttgaaaatctgtcctctgggccttctgtggcaaaagtcctcactctcttggcccaagtaggtcccattggacagtgactctgcacccatttttataccctagaatttttcctttattttgtcccatctctgtctctttcagtctaaactgacagtgtctctgctggtataaaattctcaaaagccttatcagtttcctgtataattcacagggatccaagccataagacaagaattgtcccccacagatcattcctggataactgtgtctctatccctggcttctgctgagaggtttgtggactggatccatgagttacacataaaatctcattaaaaacacctgtccagtttcatccttgacaccgtctccaggacatagtatcttagtaccctagagattttccatatcaacaagtactgattcctttttgcttcactgttaattcctcactttatctctttttctcacattttactataagaagcaaggacgagccagtctgcaccttctgtgctttgcttggaaataacctcagctaaatgttcacatttatgacttacaagttctacttttcactcaattctagaacacgattcacccacattctctgacactttataccaagtattgcctttccttcctttcctccactgaccaataatatgcttgtcatttctccataaggcctcaacaggagcactgttaatgtccatatttctaacatcagtcttgtcaagacaatctaggtttttctattaagcatctaaaaattctctcagcttctgtctcttacccaattccaaagccacttccacatttttagctatctgtatgtcagctcccttcctttggtactaacatctgtattggctccctagggctgccataaactgagtggcttaagagacatttattttctcaaagttcttaaggctagaaatctaacatcagggagtcaacatagccatgccccctctgacattctgggtagaagctgcctcctggccccttcccagcttcctctggtggccatccatctttgacaggtctaagcttacagctgtgtcaccccagtctctgcctccactggcacatggcatcctcattgtgtgtctcttctcttctttaaagaatataagtcatgttggattcagggcccaccctactccagtatgactttattttaaccatttatacctgcaatggctcccttttccaaatgagtttacattctgtggtactatgggttaaaacttcaatatgtctttttgaaagacacagtctaattcataataagaaacttcaatgtaattaacaaaagaagtcatggaagcagagaaaaggacagctagtccagcctgggatgcttagcaagacagcccttaggaggctgtgcttaaattttctatattgttgagtatattagttaaggccaatacataaaaagggctattggggcaggggctgccaagattcagtacataatatgccattcatggaactcaatctatggtggtgggttagtatcagtgttggtggtggtgggttaatatcagtgttgctgtcagaaaggaagagatccttgaattgatgagaacatgtgaggcaattccagccattatcatggcataggttatagcaagagcactgaaagtgaaaaagtcacccaggtgaacaaatctgcgtggttaataagtgtaaaggagaatgaaagctggagatcgccaatgcctatgaaaagagcacagggagaggagctttccaaatgaggcttacaatcaatgtaagataaaataaaaagagagggaatgtaattgctgaaccaagttgtcacagagctgttaggcaagggaagcactgacataagtacactggatttggcaagcaggcttttcctggcttatgggaaagcttttttttaaatagaatatggtagaaatgtaatcagcaagtataaacaacaattttaagaatcttttctgtgatgacagggaaagatagaatagtaattagagggaatgtatggttagtagggtacattcctttttcttaacttttaaaaatgagagacgctgaggtgtgagtatgtactttaggagaaaaaatagttgagcggttatagatagaagaaggggcatacttgaatcactcatggaatgtgatctcaggaagaattgagattcagagcacagatggaagtgttcactttgaacaggagactagaatgatcccaacttactatcaaaaacgatccagctttgatgatattcttccagtggttataaagtaattttcagtcctcttttatgtatttacaatgaaaaaaagggtcaaataaatagaaactgtagcatagaactgatcctggattgggttgttttctgtgatcccagtaggaaatagctccacaggttcaattatgtcaacccggtagttggcctggaaatgaacatctctgtgagactcagattcccttttctgcacagctgcgtgctgcagtctgaggagagccaagctctttcaaagccctaccccctgtcaacaagaaaaggcatgaaaagtcaattgatcttcacggctattcatccccttaccaatactgttctcaaagctttctgaatgaagttcggctttgttttatcctatgtgaatacttgaatcggactctaaatcaaaatcctgaacattcttaacattccatcatgtggtaataaatacaaagacaaatcaaaaagtaaaatattacataaggaatgaaactgaagaattgtagtcttctttcatacttaggtttattctggtaagcatttgtcattatttgaattgttattatttctatttgtgtgtttagcagcagataatattgttgatagctaccattaatatgtagtggatattaaagtgatcagtaggaagcaagaactatttaattcttgtttatatcagcttgtggatacatgataatttctccttaacctttacaaggtctttcatgattttgggggactttcgtttttaaaaaaaaaattcaatgaattttatttctctgcttttaaaaactttatttttcagtagtagtggaatatttatgctgcatctcttctgtccttgttatctctcagtttatctgaaatttttgtttgtatgtttaattttttaaatttagtttttagtttagtttactacatttaggtaaactgcatgttgcaggggtttggtgtgccgattgttttgtctcccaggtaacgaacatagtagctgatagatagttttttgatcctcaccctccttccaacctcctccctcaagtaggtcccactgtctgttgttctcttctttgtgtccatgtgtactcaatgtttagctcccagttataagtgaaaacatgttgtatttggtttcctgcccctgtgttagtttgattaggataatggcctccagcttcacccatgttgctgcaaaggacatgatcttgttccttttttatggctgcattgtatttcatggtctatatgtaccacattttctttaacaagaccaactattcatggatatttaggttgatttcatggcttttctattgtaaatagtactgcgatgaacttatgtgtgcatgtgtctctatggtagagtaatttatattttgggggggaatatgcccagtattggaatgctgggccaaatggtagttctgctttgagttcttcgagaaattgccaaactgctttccatggtggatgaattagtttcccacaacaatgaaagcatataagctttctcttttgtcttcagccacaccagcatctgttatgttttgacctttcagtaatagccattctgactggtgtgagatggtatccctttgtggttttgatttgtatttctctagtgatcagtgatgttgagcatttagtggtcttgcttttgtgtgaattcagctaaagggcacagactccttttgtcctgagaaacacctgaatagcagggcacgtgaccccacccacacctgctactgatagccaggtgggcaatgcctgctataacttccagcccagccttcctgaagcatcaatttaatacctggtgaatgttattttatgcctgagctgcagggggcacagagatgactatgacttaccttgtgtaaaaggacatcatgtgaaacagacctacaggcctattagccccatggcaactcacagggactctgacagagtacatacaggggtcagggttgggacccatggtaacttgtggtccatgctaccaaaatgaggaagaggtcaggagactctttaaaaccaacacattttaactctctgttgaaaaacagtaggttttcatcaagcagaagagagcctaaagcatttgtggccctgtggtactctctggaaaagatatacagagagcatcccaaaacaccacaacacatttaggggaaaaatacctgcttcagaatgacttcattttcagcagagtagttgccacaaagacactctaagaaatacaaacattatctcatgtccggtgttaacatactgtatttaaacatcctcccatgcagtgtgaaagatggagtgtatttggtgagatttgaaagtgagaagatgagctagaaggctcctgaattagtatagtgagaaatttaaaagggtgcataacacagaacagtgcttttaatctgcccattcatcttcatcgtcctgctgatgggacgctctgagtcccccatctcattggaccaatctcatctcctgaccacagctctcactgcctgtagtcaactttccatctttcatttagcaatggtttatatggtgcttgctgtgtttcagtaggtgtgggaacctggcagcaaacaaaaccaagactttgcttgaagagtttatctttcagtggaggaggacagtcactcattaagtaaatgcgtacgtagatagtatgttagaaggcaataagtattcccgagaataaataagcaaagcagcaagaaggcgacagaatgacagtgtgctatttcacctagagtggatggggaggcttccattctaaggtcagacctggcaagggcatgaggaagtgacatggagtaaaccaccagatctgtggggaagattccaggagacgtccaggcaggaggcagcttcctgttctgaggcagcatcaacacagagattgcactggacactgaggatggacgagctgagcttggaggcgactgtccagagatgcagcagctggggccacagtgagtgaccaatggtgactcctcttggagtgactcctcaagacaggattcccatgttagcatgtcagccatgcctcatctcctgggctagtctctgtgtcctgagtccaattcttcagcctttccattaattatgggatcaagccaatatctttcttatcaataaattttctgcttgaattccattctgttgtctaaagctaagaaacctatctagtggaggaataagttttttttacagatgctggtaattgtgacttcataataaccttaaaaatgacattagtgtgaggactttaacagtctggaataacgacgtcacggcaagacactgcctcccaacccctgaaattcacacatatgttttccacggatgacgaaagcactgaaaatgtctgttcagaaaaaaaaacagcaattgaaataattcagcatgatgccactggaaatataccaaccttaataataagagttctggctggacgtggtggctcacacctataatcccagcacttttgggaggccgaggtgggtgggtcaaccgaggtcaggagttcaataccagcctggccaatatggtgaaactccatctctactaataaaaaaaaaataaaaaattagccaggcatggtggcacacccctgtaatcccagctactcaggaggctgaggcaggagaattgcttgaacctgggaggtggaggttgcactgagctgagatggttccattgcactccagcctgggcaacaagagtgaaactctgtctcaacaataataataataataataataataataataataataataattccttgaaagactcatgcaccttcaaagcactgaaggacatgcagttcatactggctggtgagtgccatttgcaggcagttgtgttttttcccaataaaatagttatctattttaaacagaaaaatccttgggtaagatattgaaattcataaaagtgggtaggattattgcatattttcctaagcaaataaaaactataagttatgtttatatgatatacagtgtatcatactgactttataaaatttaaattttatgtttatttgacaataaaattactgaactaaagtctaaaagtttagaaataacagaaaaacagtgggaaataaaagccacctgtgatcctgctacacacaaatgctgttaccattttgatgtatgaatccatttgtaatgtgtatatttgcttacatttgtgtagatttttgtgtacatatatttgcatatatttatgtacatttgtgtatatctgtgggtatttatgttcctatagttcagattacaatgaattctgacttttggcatatagcaggggaaattatgttatcaacattttaaaaaacatttttaattgcagcaaaatattgtactgaatgtacacatcacaatttatgtaaccaatcatttatatttgaacatgcaattttttactctaaaattgctgtggatatttgtatgcataatttctaaatatgacttatttgcctaggtaaaccctaaatatggatgtagtctaagagtgtaagcttttaggctttaacccatgttgactagcactcccagaagagctgcaatatgtaagacggtgtcattaacctagaaaacagaatgcctgtgtcatgtctgccaacattcaacttagttaaaatccccaaatatatgctaaaataactccaactattttattaaaagtccatcagtgaaaacttaaaagactagaaagacacatcatttgatgtgttatagtatgccctactctgggagattgagcaaggaaaagaagaaagagccctctacatttatgggactctagaattatcttaatgcactccacggttgggccatttgaagaaacagctaattatctttcatgtgcccactgtgcacattccccagatacctggcaagattgcaaagcaccagagccaagagtgagtcactggaatttaaaggagatgagaacatttgcagaaagattcacagtgactcttagtgatgagtaaactcagatagctcagtaatgtagttcagtttagaatagtcttgccaaattcagttgatgtctgaagcttttcacatgtcactagcgagctttgtgtttctgttttatattgcaaagaaaacaatgcaaaaattaaaataagtgctggagtaaatggccgcgaaacttgcaatgtcatgaagataatatattgttctgtaaggtcccagtttatttgataaaaaataatcaatcaaccaataagcactgatgaggcaaatctttgttctgtgtgatgctggaaatcaagaagtgtgagacagaaatctaacatttaaagaggggtcaactgattccactattgttattgtagttgagaagggtttctggaaggatcccacattgtcacacatggcattgcatctttccagttgtatccatgttcagtcttcttctgagcctaatgaactgctaaaggtgatgcttcctttctcagccagatttcccattctggttcatcttgaacatgtgtgtgtctgaaagagagtgtgtatgtacggtgtgtatatgccttatgtatgtgtatgtgggtgtaagagtgtgtgtgtttgcgagaatgtgtgtgtattttatgtggtgtggtcagtgtgggtatgagtgttagaaactgtgtatgagaatgttcatgttagtgtgtatgtgtgaatgtttatagtatgtggatgtaagtctgaatgtggatgggtgggtgtgagtgtgtttttgagtgtgtgtgcacatacataatacaaactcccccttggcctgcagagaccaagtgccaacctcacttgtctttcattttaaatgcttaaagcattaagttcatattttgacatatctatcttcattccttctttatgggaggatctttctggatcatctttaaaacatggtcattttggaaacagggagattgttttcatctcacctcacacatcattgtacaaatacttgtatacattggttccattataaagaagtaggttgagggagcaaccatctaagctctttactaattatattctaaatcagtgtgctcattgtctggtttccaaagcaacggctttaacatcccctggaaacttgatagaaattcaaattatttggcccacaccagacccactggaacagaaactctgtaagaatgcatgaaaatgtgtttcttcagtgatcacttgaaagatacatggagtctccaggtttcgctgattatgaattagcctgctgttcacgttttaggcaggtcttcctatgaatgtctcttttcaactttcttacttaaatatatgggaataggattgccagatcagatagtaagtgcaggattgctacatcagatggtaagtgcatgttgaacttcataagatacctctgaatgcccaccagcaacctgtaagagcttcagctcttcatccttgccaacccttagtctgcattttttcatttgtttcacttttgtttttaatttccagaattctagtaggtgtgcaattgttccacatcttgggtttaattagcattttcctaatgattaataaacaaaaattgtgactactaatggttcaaacctacctaaacgcttgcaatgagagatatgaatatgtgcaaaaatggacatgtgctaggaaggttagctaattaagcttccatataattatttatccatttaaaatggaacattttgagtatctgaaacacattagttactatgtgatcattaagatacacagcaatgacaacaacaaaatgacatgaaatccaccttagagaattcttaatttagtggagggtgaaaatgtaagtttaatgccttacaacatgttgtataaatgttctactagatagatctacagagaaagaattagaggaccacaaggaaccaataacatatctcatgataaagattcagttaaggtttcataatgcataattatgtatatttataatttaataatattgaaaataaaagaaaataaaagctgggcatatatatgtgtgtttcattatttgtcatcctttacaatggcatataactattacacacacactcacacatagatacaaattatttatattgacacctattattgcaaaatcagctcacactctatttttctataacttactttttatctttaaatgttatgacatttctttctgggtcactataattgtgtatgtttgtaggtttacctaattgtttcttatggcttcatgatattttatagtatagctgtaatattgttatctaaacatttttaaagttatttagccagaaaacatacatttcttaaacacttcccacgacaggcattttacaagatctgggaacacaagaatgaattcctctgtgtgttttctacagaaacccagactacagttaagatgaaggatataatatgatttataatacaaggacataaagtttataacagaggagctataaacaaagaaaagtgaggaagagagtaggagcttgaagaagaattcacaaggaatttcatagcaaacataaaaattttgctttttactttttaacacaaacctgcaattaaaaagattatatatatatatatatatatttgggttgaatgaatcaagcagttggttaagtgagagaatttatttattttttaagaaaaggtaaccagaagtaaaatgaatgttgataacattgtagttaggtttattcaggaagagataaggttttgttaaagaagctgatggtaaatgaagtaaaattttctaatggcttgcatttttactttatacaagtgttacaagcatatgaatacaggttgatggatgtatttcatcatgttaaaacctctcactgaaattttgcaaaagcaagacaaattaaaaataaagtccatgaccagtgtggtggcttacacctgtaatcccaacactttgggaggccaaggcgggtggatcacctgaggtcaggagtttgaaaccagcctggccaacatagtgaaaccccatctttactaaaaatacaaaaaaattagctgggtctggtggcgggcacctgtagacccagctactcgggaggctgagacatgagaatcgcctgaacccaggagatggatgttgcaataagtcgagatcactccactgcactccagcctgggggccagagcaagactccatctcaaaataaataaataaataaataaataaaaataaaaaataaataaagtccatagtgtctcccattacccagaacaattacattatatggccatgctgtgtcgacctgacagaatgttccatgtgggaaatgttctagtgggacatttgtttacatgtttctgatttccaatactcacaataatatcactttctgtctgaggtgaaatttcctgtctagttttcaagttttgccttgctatattttgtactactaaatttttattgagaaaaacgttgtgtttgttccttatcctcccttggcattaaaatactgaatggaaatggggaatacaattatattttagcagtggaagggatgactctagaaaatatttcctaactagggtgacaaatagtaactggtgtagcagaaattgcttctgtgtattaaagacttattcatattagaaacatcacttttcaagtgtctatggatactcttttccaccaaactgtgccagatagtctcgtacttttaaacatacatatgcataacatttgctcagatgcaagtttgataagaatcacttagcaagcagtctgtaaaagcaatttagaaagaaccaatatgttactgtttgggcgcataactctgttggtctggtttaattttagagtgtattttagtataatggatatgtcacatattcctgagtacaacctccattgaaaatgccttgtatttagttgataatggggagtaacatattaagactgacttcctaggtcaaaacttggaatacagctacactctgctgcttattaaaagttacatcatataccttaatcagtattaaaaattagaattccttttaacatgaggtagctgagaagcataacaagaacatgtcaccagaagccttccatcaacctcggtatggatttgagtccatgaatcctggagagcaggaccagagtgatgacacatttcatcagaagcactgacacacagatgcagtcacacacattcacttccaacatcctggctagaatctttagcctagaaaatttcatccgattgaatgaaatgcctacttaaaaaaataactttgaaaaacactacttcaagatatgctatacgaaaccatcttaatgattaaatgacctactttttagacaaattacttagaatgcattgtatgttcgggccacagatggaaggcagatggagaaatcaatcaggaaggaaacataaaaatggagacaatagttccagatagtgttgattttgataggacagaataacctaagggtgaaatgatagtggtgagtatgaggtccagcatacctaggtgaggtcatcaaggatgggctcctctgagcaggagatattacaatgaggaggagccagctgcatacagattttcaggaagaatttccatgggttatacagggacctagtcctttaaggtgctgtaagtgaagggtgagaattttatatgtttcatgcctttagcactgtagggtgaattggagggctcaaaaataggactggggatcatttaggaagcttcttcaggaatggggatggagtgaatcatatgcttccatttgcactgcagggaccagcaggtaagaatgagtggcaggcgactgagtgggcaggaggagcggctgtagattgggagttgagcagtgggtggataaacgttctactcacatatataggtacacagagcattttttatataaaggaaagggatcaatagttgtaaaagaaagggatcaatagttgtatttttattctgggtttgagacacttatgaaaacttctagtagcattgtcaggtcagcagtcttggtaatcttgaataaagatcaggaaagagagcaggacttgagctgcctgcagtgctctgggctttgggggtcaggatgacagaaaacaatgacaaaaggagatgagaaggaacaccaaatgaggtaggaacaccagtcacatgtggtgccctccacgccgagaggactcagtgcttcaggaatgatggcaatgccaaccatagggaggatgccaggagtgacagtggcagagccctggccacctggaggacagcagtgttaggagaaaagggggagcctcattggaatggattgagggattgaggagactcttcatcgagtgctagtggagacaatgactatagacacattttaaaataagtcttgaaacagataaatatgaaaaatctatatacaaatatatatagctagatggaattatagactcagttttatttgcttgcttctttgcagaggaaatagctctgtatttttgatattttaatatttacttttagactaattcatacataactatttattattcaaaaaaaattgatgtgaaactaatgaagtaactcctggttgcagatcatagtcaaagaagaagcctactaatgtgaattttgggcccttttgtagacttactcaagatgaaactctagggatgaagcctgactgcatttactgtcttacagaaaaagtcatggcagttggggcggtgttgagaaactcatgctgacatactctgcttcagggattaataacacaaactgaaatatttttctcacccgacaaagtttagggaaagcagaactgattgttccaaaataacaaatttccttattgtcaaaagcactttttatttttatgttcatctattttagaaagtagcagtttacatatttaaataatttaaaattagatatatatttttgaataattagatatctatgaataataaaattcaaatacatttaaaggggaaataatatagcatattcaaattctaataaaaatatatagatgacttgaactatctttgtatcatgtaccctagaacttaaagtataataataataaaaaaaaaaagaatgttaggtggaaacttgtagaaatatagctaaatatagataaatgattttgttaaacttattaaggcactttggaaagaaaattagaaaaataaaatgcctatacttaatgttattttgtatgaggataaggaaatatttcaactaaagagtatccaatttgtgtgtgtgtgtgtgttttgtgtgtgtttgtatgtgtgtgaacatgctttcaagttacttggataaatgcttaaaagtgggaatgcttggccaggtgtggtggctcatgcctgtaatcccagcactttgggaggccgaggcgggtggatcacctgaggtcaggagttcgcgaccagcctgactaacatggtgaaaccccgtctgtactaaatacaaaaaaattagccaggcgtggtggcgcatgcctttaatccaagctacttgggaggctgagacaggagaatcgctggtacctgggagggggaggttgcagtgagccaagatcacgccattgcactccagcctgggcaacaaaagtgaaactcagtctaaaaacaaaaacaaaaacacaaaaacaaacaaacaaacaaacaaaacaaagtgggaattctaggttgaaaggtaaggcaggcttacttatctaaaaaactgccaaactgtcatccagagtggctatgtcgtattgcaaccaattgtcaatgtgtgaggattcctgtgcctgccgatcctcaccagccattgatattgtaagagttttgtttaattttagatattctaaaaattatgtagtggcctttcaatgtagtttaaatttagatttatttatattattatttgccattaatatgtcttctatggttaagtgtctgttaaaagtcttgtgatgattttttgttctttttttttcttgttgagttttaagatttttttatacattctggatataaattctttatcacatatatgatttgcaaatattttctctcactatatggctgtcttcttattctcttaacaatgtgtttcacagagcaaaagtttacattttaattaagtccaatttttaattttttttttaccatatatcctgttgatgttgtatttaaaaccaaaggcaggagtgtttgaatgtgacaaggatacagggaactttgaaagtgataaaattcttctgcatgatacttgggtggtagatacatgactctacgcatttgtcaagagtcatctagtaaatttgaaaacaggtcatttaagaaaaatcaaccaggacatcagggaatgtcagaatggaacgcagactgtgaaaaatgaatcaaactatattataaatgtataacaaacttcactgaaggtggtaagggaaaaattggagctgacttgagaaacatcagaaaaataactgttttgactggtaactgtaaagtaagctaaagacaaaagaattatagaattaaagaattaatcactgtaccttatttggaaaacttgttttttacagaaatggaggttagaaattttgaaaccactttacaaatacactagggtttgacaaataagtaataaaatataagtaatgggttactctaaagagtgactttggagtagataaaccttgcagatgccaccttgaccaaattgattcagcattttttctgtcagaggaataagccaggagggatggtggggattgactttgaagctcatagttctggattacatctggaggtattatgaatttatttaattcaataacagatacagacagatacataaattatatgagatgcaggttaggatacatgcatgtattgcctagctgtgcacatgcatgggatctagaagcactgtaattccagtaaccataaacacactgcatgtgccatgcctcagtttctaaatattactctctaatgaaatgaaccaggatttcctggaaaaatggctgattctctacttgagacagggaaaatagaggataagcataatgcatattataatgctagaaagtagaatactggcaaaaatagaagttaaataaagatcaggttatatcagaaggacatgggacccaatctgaaagaactcacaacagccaaagtttgtacaatttgagcaaaaatatgcgtaacatagcgtgtgtgtgtatacatagatatatatcctatataaggtatatgtatatatctatagacactatattaaatataaaataaacatacatgaatatgaattcatactggtataaaaatgattatgaatataaatatatggcacagggggatcttccttgcagaggaattcagaataatatatgttgatatacctcctttcaagaagtggagcttaatatcactacttttgagtgtaggttggacttagagactcactttcaaagaataaagtacataaagtgagaaatagtaactttattttttatttgtttattaatttttttattactttaacttctagggtacatgtgcacaacgtgcaggtttgttacatatgtatacatatgccatgttggtgtgctgcacccattaactcatcatttacattacatatatctcctaatgatttccctccccccaacccagaacaggccccagtgtgtgatgttccccttcctgtgtccaagtgttctcattgttcaattcccacctatgagtgagaacatgcggtgtttggttttttgttcttgtgatagttggctgagaatgatggtttgcagcttcatccatgtccatacaaaggacatgaactcatcatttttatggatgcatagtattccatggtctatatgtgccacattttcttaatccagtctatcattgatgcacatttgggttggttccaatctttgctattgtgaatagtgctgcaataaacatacgtgtgcatgtgccttgatagcagcatgatttataatcctttgggtatatacccagtaatgggatggctgggtgaaatggtatttctagttctagatccctgaggaatcgccacaccaacttccacaatggttgaattagtttacagtcccaccaacagtgtaaaagcgtccctatttctccacatcctctccagcacctgtagtttcctgactctttatgatcaccattctaactggtgtgagatggtatctcattggagatttgatttctctgatgccagtgatgatgagcattttttcatgtgtctgttggctgcataaatgtcttcttttgagaagtgtctgttcatatccttcacccactttttgatggggttgtttgtttttttctcgtaaatttgtttgagttctttgtagattctggatattagcactttgcaagatgagtagattgcaaaaattttctcccattctgtaggttgcctgttcaccctgatggcagtttcttttgctgtgcagaagctctttagtttgattagatcccatttgtcaattttggcttttgttgccattgcttttgttgttttagacatgaagtccttgcccatgcctatgtcctgaatagtattggctaggttttcttctagggtttttatggtttcaggtctaacatttaagtcttcaatccatcttgaattaatttttgtataaggtgtaaggaagggatccagtttcagctttcttcatatggctagccagttttcccagcaccatttgttaaatagggaatcctttccccatttcttgtttttgtcagggttgtcaaagatcagatggttgtagatgtgtggcattatttctgagggctctgttctgttccattggtctatatctctgttttggtaccagtaccattgctgttttggtcactgtagccttgcagtatagtttgaagtcaggtatcgtgatgcttccagctttgttcttttggcttaggattgtcttggcaatgcgggttcttttttggttccatatgaactttaaagtagtttttttccaattctgtgaagaaagtcattggtagcttgatggggatggcattgaatctataaattaccttgggcagtatggccattttcacgatattgatttttcctatccatgaccatggaatgttcttccgtttgtttgtatcctctttttttcattaagcagtggtttgtagttctccttgaagaggtccttcacatcccttgtaagttggattcctaggtattttattctctttgaagcaattgtgaaggggtgttcactcaggatttggttctctgtttgtctgttattggtgtataagaatgcttgttatttttgcacattgattttgtatcctgagactttgctgaatttgcttatcagcttaaggagattttgggctgagacggtggggttttctaaatatacaatcatgtcatctgcaaacagggacaatttgactacctcttttcctaattgaataccctttatttctttctccttcctgattgccctggccagaacttccaacactatgttgaataggagtggtgagagagggcatccctgtcttgtgccagttttcaaagggaatgcttccagtttttgccctttcagtatgatattggctgtgggtttgtcataaatagctcttattattttgagatacgtcccattaatacctaatttattgagagtttttagcatgaagggttgttgaattttgtcaaaggccttttctgcatctgttaagataatcatgtggtttttgtctttggttctgtttatatgatggattacatttattgatttgtgtatgttgaaccagcctgtatgttgaaccagacttgcatcccagggatgaagcccacttgatcatggtggataacctttttgatgtgctgctggattcggtttgtcagtattttattgaggatttttgcatcgatgttcatcagggatgttggtctaaaattctcttttttgttgtgtctctgccaggctttggtatcaggatgatgctggcctcataaaatgagttagggaggattccctctttttctattgattgggatagtttcagaaggaatggtaccagctcctccttgttatctctggtagaattcggctgtgaatctgcctggtcctggactttttatggttggtagactattaattatttcctcaatttcagagcctgttattggtctattcagggattcaacttcttcctggcttagtcttgggatggtgtatgtgtccaggaatttatccatttcttctagattttctagtttatttgtgtagaggtgtttatagtgttctctgatggtagtttgtatttctgtggaattggtggtgatatcccctttatcattttttattgggtttattttattcttctttcatttattctttattagtcttgctagtggtctatcaattttgttgatcttttcaaaaaaccagctcccggtttcactgatttttttaaaggcttttttgtgtctctatcttcttcagttctctgatcttagtcattccttgccttctgctagcttttgaatgtgtttcctcttgcttctctagttcttttaattgtgatgttagggtgtcaattttagatctttcctgctttctcctgtgggcatttagtgctgtaaatttccctctacatactggtttaaatgtgtcccagagattctggtatgttttgtctttgttctcattggtttcaaagaacatctttatttctgccttcatttcattgtgtacccagtagtcattcatgagcaggttgttcagtttccatgtagttgattggttttgagtgagtttcttaatcctgagttctagtttgattgcactgtggtctgagggagagcttgttgtaatttctgttcttttacatttgctaaggagtgctttacttccaactatgttgtcaattttggaataagtgcgatgcagtgctgagaagaatgtatattctgttgatttggggtggagagttccatagatatctattaggtcagcttggtgccgagctgagttcaattcctggatatccttgttaactttctgtctcattgatctgtctaatgttgacagtggggtgttaaagtctcccattattattgtgtgggagtctaagtctctttgtaggtctctaaggacttgctttatgaaactgggtgctcctgtattgggtgcatatatatttaagataactcttcttgtcgaatttctccctttaccattatgtaatggccttctttgtctcttttgatctttgttggtttaaagtctgttttatcagagactgggattgcaaacccctgccattttttgttttccatttgcttggtagatcttcctccatctctttattttgagcctatgtgtgtctctgcacatgagatgggtctcctgaatacagcacactgatgggtcttgactctttatccaatttgccagtctgtgtcttttaattgtagcatttagcccatttacatttaaggttaatattgttatgtgtgaatttgatcctgtcattatatgttatctggttattttgcttgttaattgatgcagtttcttcctagcatcaatggtctttacaatttggaatggttttgcagtggctggtaccggttgttcctttctatgtttagtgcttccttcaggagctcttttagggcaggcctggtggtgagaaaatctctcagcatttgcttgtctgtaaaggattttatttctccttcacttatgaaacttaatttgactggatatgaaattctgggttgaaaattattttctttaagaatgttgaatattggcccccactctcttctggcttgtagtttctgccgagagatcagctgttagtctgatgggtttccctttgtgagtaaccagacttttctctctggctgcccttaacattttttcctccatttcaactttggtgaatctgccaattatgtgtcttggagttgctcttctcgaggagtatctttgtggtgttctctgtatttcctgaatttgaatgttggcctgccttgctaggttggggaagttctcctggataatatcatgaggagtgttttccaacttggttctattctccccgtcactttcaggtacaccaatcagacgtagatttggtcttttcacatagtaccatatttcttggaggccttgttcgtttctttttactcttttttctctaaacttctcttctcacttcattttattcattcgatcttcaatcactgataccctttcttccacttgatcgaattggctactgaagcttgtgcatgcatcaaatagttcttgtgccacggttttcagctccatcaggtcatttaaggacttctctacactggttattctagttagccatttgtctattcttttttcaaggtttttagcttctttgcattgggttcaaacttcctccgttagctcagagaagtttgattgtctgaagtattctctcaactcgtcagcatcattctctctccagttttgttccactgctggcgaggagctgtgttcctttggagggggagaggtactctgatttttagaattttcagcttttctgctctgttttttccccatctttgtggttttatttacctttggtctttgatgatggtgatgtacagatgggggttttggtgcggatgtcctttctgtttgttagttttccttctaccagtcaggaccctcagctgcaggtctgctggagtttgctggaggtccactccagaccctgtttgcctgggtatcagcagcggaggctgcagaacagcgaatattgctgaacagcaaatgttgctgccagatcgttcctctggaagcttcgtctcagatgggtacccagctgtatgaggtgtcagtctgccccctactggggggtgcctcccagttaggctactcgggagtcagggacccacttgaggaggcagtctgtctgttctcagatatcgaactcctgctgggagaaccactactctctttgaagctgtcagacatgaacatttaagtctgcagaggtttttgctgccttttgttaggctatgccctgcctccagaggtggagtctacagaggcatgcaggcctccttgagctgaggtgggctccacccagtttgagcttccaggctgctttatttacctactcaagcctcagcaatggtgggcacccctcccccagcctcgctgctgccttgcactttgatgtcagactgctgtgctaccagtaggggcagactgacacctcatacagcccggtacccctctgtgggtgtgggaccccccaagccaggcatgggatataatctcctggtgtgccgtttgctaagacccttggaaaagtgcagtattagggtgggagtgacccaattttccaggtactgtctgtcaccgcttcccttggctaggaaagggaattccctgaccccttgcacttcctgggtaaggcgatgcctcaccctgcttcggctcacactcggtgggctacatccactgtcctacccccactgtccaacgtgccccagtgagatgaaccgggtacctcagttggaagtgcagaaatcacctgtcttagtaactttagaatagagaaacccagcagacgccactgtaaccaagagggcaaggtatatgttaccagaaataagtcctgtcgttcctcaaataatgaaataagaaagatgctcatctctgtgatattcttcacaaaaatctttaaacctagtctaaccatggggaagcattgaactaaccaaaattgcaaccatctataaatcacctggcctatactgatcacaactatcaaggtcatagaaaacaaaacacctgaacaaaatgccatcgattggaagtgaccaagaaaacatgatgactaaatgaaatgtggcgtgttggatgaaatcttgcagtgaaagaagacattagtggaaaaaaggtaaagtctgaatataaagcctatagttcagttcatggcaatgtggcaatgttaacctgttaatggttatgtaatttgttacacttagaataaaatgggtgtaggttatagagtaattctgtgtactatacttacaacttttttctatgaaattatttcaaagtaaaaattcaattgaaataattttaaaatagcttgtgaaagaattagatttttcttttacttgagatcaattaatagagaccaaatttgccaccatgcttgaaacaaagttgtagtgctgctgcatttgaaagctcaaaataaaactaccttgattacaggcagtatggtcctgttgtaaaaatacacagagagatcataagaaaaggatagagagtacaaaattagacccaggttcacatgatcagttggttttcatctaagttgcaaaggcaattcattaagaaaaggattatctaaaaacaactggtagtagaacaatttgatatccacagtaaacaaaaataatctcaatcaacaattcaaaaattagctaaaagtgtattagagaactaatgtaaaagttaaaaccacaacagttatagaaaaaaaaatggaagaaaatatttgtgacctttggctaggcaaaaaattttaagttatgacactacagaattaaataagagataaaatattctataatgtttagaaattcccaaatatttgtaaattaagctatgcacaggaaaccacaaaataaatgagaaattatagataatttaaagataataaacatttgtaagatgaagcttagagggaaatgtatagccttaattttttatattagaaagaataaaaggtttatgataaaaacatcacctttcactctatagggccatctgaagaaagatttaatgtaattcaaggtaagttgaagaaaacaaataataaaggtaacagaaaacaaacataagatagaaataataaagacaaaagttgtttgaaatgatgaataaaacaaatacatctctagttagaattgtaaaagaaaataaacagaaaaatcacaatttgtcagagcaacaccatgaatactacatatatagaagtgtaaaaaggaaaaaaaataaacactattcagtaaagaaaaaaagggcaaatgaaatgaaatgaaaacttttattgaaaaatagaatctgctaagactaatacaaaaagaggaaatctgaatagccttattttgtttaaataaatgaaattgagacttaagacttcatcctttgcccctatacacaaaacacccccaggtacagttggcttcattagtcaactctactaaaactcaggaaacaattatacaaaacttacacaaactctttcaaaaaatacaaggagaggaaacattcccaatttgttgtacgaaatcagtatggccctgaatccagtattgtcaagtgctatagcagaatgaaaatgtattaaaattacggatctataacgcttatgatcacggatgctaaaatcttttatgaaatattgtcagatctcattgagcaatacataaaaggataacacatgttggccacatagatttagtctagaaatctaagattacttcaaaatacaaaaatcaatatatgcactgatcaatatatggctgatatatataatgtgaatctgtatgtatatatagttatatatgtattactgtatacagtttaatatataacctaaaatataggttgggatatgtgcatgtatttcctagttgtgcccatggacaaaatgtatcaagaataataaaaatcattgctaaaaagacaaatcagcccattaaaaatgggcaagtgttctgatcaaggacccaggcatgccactaaagaagatgtacaaattgtgaataagtacatgaaaaggcgctgacatcattattaatcaagtaagtggaaattaaaccatcttgggctaccacgtcacacccactagaataactaaaaggagaaagactggcaataccaagtgttgttaaggatgttgagcaactgaactcacaagcactgtgtgaaatgtaaaatggtacagtgcttccatttccaagaggaataaaatcaagtgttcatagcagtttttcatatctaaattgaaactgcacaaaattctcatgatcaaatgaatagataagcaaatggttttatatttatgcaatgattgctactcagcaatacaaagaatggaatactgatagatgcaaaaacagagctgaatctcaaacaaggaagactagacaaaaatagatatcaatatctatagatgtatggacacttccatatgtctgaatatagatatttagatgcatagctgtggtagtatttcatttgtttgctttctaggtaaattaatctatgatgatgaaaatcagaagagtgactgtgcctgagtgctatagaaatgttctgtatcttgatcagaggagtagttacaaagctatataggtttgctaaaactcatcaaactgtgtctttcatatatgagtattttattttgtttaaattgtccccccaataaacacttatatttaatgattacttgataattctttaaggtaaatctgattataaaaatacatattagtatacacaaaatacatattattcaacacacaattaaaaacttattcttcgcataattattattgtcttatcaaaaaaggaaggttaaatagagcagcaaaagcctttaagaaaattttaaattatggaatttccccgagcttgcagataaggtattattggatgacaaaataaaatgtgatatttaggacttttcattataaatcattaaaacggaggtaaaattcaagaattcagccaaggaaacaaaacaatgtgcagcttcttgagattgctactggtgctttgtttacagcactgagacctttcctgtcttgcacattcatagaaatgaaaataaagaaatccatagaatcgagaatgttataaaagtagttaccaaacctagatggaagttaactttttcaaaaatttctaaagaaatgttcattgacagataaaagcaataagtggttgttagttttggataagttaaatgtatattttcttttcccagggcattcctggcttatgtcaactgtcctggcaaattgtaaatacctcttcctatcactctcccaagtgacattgtttgggtggcaaattccatgatcatcttagtttgggagacctggtccatttagacatcaagataggcacttttggttcatttcttctactaagcagtaaagggttctcttcccattatcaggttcagattatggtagatccatgatatccaaagctttcttgatattttaatgtcacatggctggaattttagaaaattcttgaatttatatgaaatctattcatctttcacatatgtagtcttatttttagcctgtctcttaggaaataaaaaacaattgtacccatgtgcaaagtagcttcttgggtgggttctcaaaactttttaagtataggaagatgaccatcagagagcactgggcagagtccccagggattgacaatactcagtgaatgctatgcctatgatcatggagcacacacaggacttctatttagaataacagggtaatagtattagcttcaatttaataaaaacaattttaaatgcaaaataggaagtcaaagtttgttaattttcaactatgcaattattgaatacctacagacattttcctatttttccacgttgatttatgtagctggagttcattgtttttttctgttgtaatcaaccttccattgcagtaatactgcataatttgtttctctattccttattacattaacataacttttaattgattcaattttttgctatgataaagatgctttggtgaacagacattctggtaggccttgatgcacatgtgtaagaggatttttgttttttaagggtatatatctggtgatagaatcgctgagaccttggatatggacacctttaactttaataaataatactagactattttccacaattattttacaaatttatgttcttactagagtttacaaaccagttgctcctcttagtctcaagcatttattgtctgtgtttgcttctaatttgatggttgaataacgtgttgtgaacggaatgtgcctttgcctgataactagtgggcgttgagtgctttttgatgaccggccgtttgggttttttctcttctaaaatgcttgttcctgtcttggctccatgtttatattggattatttgacttttttctttattgacttttagaagatttttgactattttaaatattccttttttttcacttgcaatttgttgcagttatgttctatgagtttgttactaaactctttaggtatgctataaaccagtcttattttctgtccacttgaggcaatactttcaaacatctagattttacgtttcctggttataccaaatttctgcagtataaattatcttattcctattatttgcctactgttggcttaggacaggtttaggcattaggcttctaagcaagttactcatcatccatctggttttaaacttccaaaacattgttgtgtcctccgctgttctttgtaattattaatttgtgtttttctagtctctttactataatctcaatgagattttggtcaaaggaaaaagcaaaatgtgagtctttactattttatcatgtttatatagagaatattttcactatttgacatgtatatcaaaaaaggaaataaaatagtagtcattgttttgcagcttcaatgaaactaaaagccatacgtgtgtacttgagtatttgactctctcagcaattttattcagtacctgagcctagtgtttctatggagtgttcacaggcatcctctcattctacccttattcatttggtcccattggtcttacaggttccattatatatgacaaggaatcacagttcaaaaaccttaattatcttgttctggagtaccaccagcagcagttgaagaaattaaaccaagttcttcagaatccacctgcagctccctctcctactgaaaaatatacccaattacctaagttgggcccttacctggtagacttaaactgggagaaattttaattcagaacaataaaacagtagcaaactctgcatgtttgatatttatgcaggacaacatattgagtaatgtgtttgttggtttttctaataaaaggaggacatgctcttgggcattgcacttaattttctatgcagtttgtgtctcatcttctgagaaaaatttactaatctttagggttggaagaactatttctagataatactcacctggagccttatggaattgaattcaatttctgacacataaacgttgttacagcaaattgactttcaataatatctgaaatttttgtgttaaagggatgatataaacaatatctcttctaatggtaactggtaaccttttgttgacttttgagatgaatttgaaagggaaaatgctattgctttgaaacagttacctctttccaagaagaaaacctctcagttttcttaaagggtcatatggattgcttaagattagtcctcatcacttagaagcatggacattcttttgcttttctgtgctttcattttatatcacaactaggatagtttctaggatttacatttcattgtgaatgaaatgtaaataaaataacatagtgtattagtaaatatccctgaataacaaggcatgtgatttgtgatctgagtcataatatatttctgaaatctcccttagaaatactatgcatagctaattattgccttataatgtatcctatggattttgaacctgaagtcatactcatacttgtatcagcttatttgatactcatagggatcttgcagaagcacggaatagctgtagtacttttttgggagcacagaacttgggcatagaacatagactgtagagaatattttttgaaggagttttgaaaacaactggacacaagcctggaagaaggataggagtctgagaagtgtggggaaaggggagttcaggcagacacagccaccaatgagagggaccactgctgcaaagagaggatttcatatttagagaatggcaatgactttggaatagtaaaatagagaagatgatattttaatgtcaagacttatagatagatcattaaggacagtgaatattattctaaatgatactgattgtgtcctgaagatgatgatgatccatgaaagaacttattgttgaagaatcacatgatcacataagttgaaattttatgtttcaaaaagatgacttcagcagcagcgcatagaacaaatcagggattttatatggaacactatatgatcagtttttcatgattatggaaatctaagcaaggaaaagtaacaggataagctaaatgaggtagaaagacttaaggaaagtacacagttgggaaattatctggagattttagtagaacttgacccattgattgtatagggccaaagtgaaggaagaaatcaaatacgaagttcagtttcatggcttggggcataagagttgtgatgacactattaatagattacatggaaagacaggcatgttttcgtagggaaaggctaactttcagtgtccatgtgctgattctagggactttccaagaggacctgatagtgtgtggtgcatgtgttgtgtgtggtgtatctgttgtgtgttctgtatgtgtatctggagttcagagaaatctctggcctagagatagaatcagtgattggcccttgagtgcatgaggtaagtatagatttgaaagcccttgtctagtgagggaagcattcccacaaaaaaggtatggaagaaacagaaaagaaaaagaaaaagaaaaaaaaagtcacccaatcaaaacatcctggatagcagcaatatttaaggggcaaaaggaaagaccacaaattaggttaagagataattgtctttaaaaaaacacaattcattccctattttgcattaataaagcatataatcttagacaagcattcaaaatccttcacaacctggccgaaactgcttttagaagaatgaaagagaggggaatgatatttagggaaggagaaagagaagaggaaggaggaagagcaagagggagaagaaatgctgtgtgatttgtggttgaattgaattgtacagcgtcagggaaggtggagagcttgacttgactgccacttgcttggcaggacaaaataaggaattgagatagaattagtcaccctggttcttgtcagagcagctctgtgaataacctgagagcaggaaaatagtgtcacaaagccaatgggaagtgaggctgcccagagtgaaccctgcggcctgctggctataagaaagcaccggccgtgcgcggtggctcatgcctgtaatcccagcactttgggaggtcgaggcgggcgtatcacgaggtcaggagatggagaccaccctggctaacacggtgaaaccccgtctctactaaaaatacaaaaaattagccggacgtggaggcgggtgcctgtagtcccggctacttgggaggctgaggcaggagaacggcatgaacccgggaggtggagcttgcagtgagccgagttcacgccactgcactccagcctgggcgacagcaagactctgtctcaaaaaaaaaaaaaaaaaagaaaaaaaaagaaagaaaacaccagtccctagcagaacttcatcctccatcatgcttcccttcgttagcccgctggatctccagttgaggtgctatctaatctaggacatcaggataggaaggggtatttacgtcacatgtgtgaagctgagtcctctgtcctgattgacatcagcctggccattcctcatgattatgcagtgacgtgttctgctcctgccatctgctcccactgctgttcctggaggtaaacatgccccggctatcccagcttcagagcatgatcctcttactgcctcatgggagcctggacccagaaactttctcgcatattctatagcaaggcacagccgagatcaccatgaaatccttaggaagcctttctaatggctcagggcaaacagaaggggatggcatctggtgccatgtggctgcttccaggattcatggttccagtcttttcccatagagttgctaactacctgcttccataagcaactggctaggtcccagttcactcttcagaagagaggcctctcccttcaccctccagggaggccctttctggtctctctgtagattctatcaactgggaagaaagcaactctcctcaactcagccagttattccaccgccctttagtgagacagactcgtttcacccacagaaactaaatcccatattctctagttttaaattttgaaaactgtcttctcaaccataacctatataacctattgattagaagacgacttttctgtgtcgcttttactgttgcttccgagtattccaaaatataatttttccaaaatttatgtcttccagttataattccaagtttttttttttttaataaacaaactaagtattacaaatttctcttcaggaattttcttcttttttctttttttttttttttagacggagtcttgctctggcgccaggtgggagtgcagtggcgagatctcgggtcactgcaacctccacctcctgggttcaagtgattctcctgccacagcctcccaagtagctgggactatgggactacaggcgcccgccaccacgcccggccaatttgtgtattttaatacacaacaggatttcgccatgttggccaggattgtctcgatctcctgacctcagggtctgccgcctccacctcccaaagtgctgggattacaggcgtgagccaccacactcggcccatgaatttttttagtaaaattgatttgcttttataatagaagattatttagactgtagtttaagattctaaatggaacatgacaagtttaagaattcaaaaatcttcatcaatatcacttgttggatcctaccttttcaagataatgactacatctttacaattgctgcctttagcactgcaaattattgaactgacagactgaaatctatgggtttgatctacctcttgtatttgctttttcctcttatctctcttccattttaatgttcccattgatctcagagactttgatagaaagacacaatttctttttttttttttttttttttttttgctatctatcatcatgggcttgctgaatatgcttaaactatggtcagaagtaaaaatgaacagaaagctaatttttcacaatgcttgtctgaattggtcaaggagaatagaacattactctgctgctattcagatgctttgccatggctggtacagcgtgatgcacagttacaaagaactttgcgtatgaacatgttctgttccagtatcaaattctgaaaggggactgcttttttccagagaactggcaattctccattgacaagcatgaacagtggataacaaagcaaaccttgtttactggtacttattcatttaaagctctatcaggcaatctgactgaaatgatagttttgttctgcaaaatcaaaagatatttaaaattagataggttgttaagtagataatttttagtgaacacattttaaattactaggggatatttggttgcaactctttttgtgcatacaacatattacatgtcataatataaatttcacttatttatttgtcccttgttttctttccctgctacattcacagaccctagaagagcgcaaggtccctaatatgcactcaaatatgtagtgaatgtgtaaatagaagtaactcttcaaaatatgcaactcttatgttaacagttgggaaactctttggaaaaaatattatctccaactatgaattctactgttaaatacttattatgctccttggctttattaaatggtatggctatacaacatcagaagataaagttcattcttctgaatattactctaacattttggtcaaagaatgagtcatcccttatttataggtttttaaatttgctttcagcttattttatgtatgtcataaattaagacaatagtgactctaactcatagaaactatgcttccccctccccagcaggaaaaataatctttcatctcccacacacacacacaaaaaatgttgaattaggtgtcaggtgtttatactattttggatagaacagtgttgagttctgctttgatgagcttcacaggcatagctttgcttactgaaaagagagcaattagcttcatattgctcgatttaattaagtgaggtcaatttaacttaacatttagtctccatccccagccagagattcccattcaccttgctccagcaagttgtcagagtgagaaaagattaattttctatatcacagtgcagtcagtgacagagatgaggctttagcaaactgatgtttggatgtacagaaatcatttttgcaggtagtgatttattcaagcaagaatcaggaaaatgtcaaaacgtatccaaaaattattttgtgtcctgtatactgatgtttgctgtagagtttgttcatccttgtactcatctccagatagagcttttgtatctggaaagagtacaattgacttaatattgcttaatttaagtgaagcaattaaatttacgtcatcttcagccacggacactcatcgaccatgttctgcatattatctgcttgaaaattgctgccactatggccatgccatttttattttccttcttcagtgatttgcaactataattttcagatagtaacagaaaccctggattggaaaaccttagtggttcctaaaaagatcgagatatatgttgatacatacatttgtcatataaccaatgggcattactagttgaacctaaagtcgcattgtaacttaaatgtcatccaattatgctggaggcatcacactacctgacttcaaactatactacaaggctacagtaaccaaaacagcatggtactggtaccaaaacagagatatagatcaatggaacagaccagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcagcgacttggaaccaacccaaatgtccaacattgatagactggattaagaaaatgtggcaaatatacaccatggaatactatgcagccataaaaaatgatgagttcatgtcctttgtagggacatggataaaattggaaaccatcattctcagtaaactatcgcaagaacaaaaaaccaaacactgcatattctcactcataggtgggaattgaacaatgcgatcacatggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttaaagtataataataataataaaaaaagaaaaaaaaaagattaaaaataaaaaaaataaaataaaataaaataaaaaaaaaaatctttgaaattaggaaagcaaaagagtctgtttctaaaccaacttttcctatatgtcactcaggtattgaatcttgtgtatgtaaaacctttcatatcacattccttcaaatcacattgacctctctggaccgtgattatatgtaatggtcctgataagaaaatatatttggccaagtgcggtagctcatgcctataatcccagcactttgtgaggccttggcaggcagattgcttgagcccacgagtttgaggccagcctgagcaacagaacaaaacctcatcgctacgaaaaaaaaaaaaaatacaaaatacaaaaattggccagacatggtggcatgcgcctgtagtcccagctattcaggaagctgagatgggaggatcctgtcagcctggcaattcgaggttgcagtgagtcatgatcacaccagtggaccccaggctgggcaagtttgcaagattctatctcaaaaaaaaaaaaaaaaggtaaagaaaaaaagaaagaataaagtaaatttgtttcactcaagtattattttgagagagatttagaaagccattaattagtttgcatatcattatgattttttctaataatttaaaaattaccttagataagtattattttaaaatacatgattacttaatgaaggaatctaaattttaacttataatttgatgttatgtggctacttcttgtgctttatttctcttattgaaatgtaaaaatataatttaattacaattcctttaatttgtatgataacacttaagcaagttaaatcattaataatctttttctaaaatgtttaatatttcccaacttcctgaaaaaaatctacacatctttaggaaggaccatatttgtgaaaaattataattcctgactattaattttattgctacatacttcatacaaacacaaaccagtttacattgttaacataaagacaatcaaatgtaaataaggccacaaattgtagatttactattaagaccaagtcattccattccttatattactgccattaagtaacaatttgtttttttctctaatagtaaaggaaagaaaatatgtacctctcatctgaagatatgcacacacaaacacataaacagagtatacattataagatgcatttttcttgttttactttagtgtgatagttgacaaagacaaaaccttaacacatccgtgtgtgtatacatgtatatgcatgtgtatatatatatgtatatatgtatgttataaagcatattaataccaaaagaatctgtgaatctattacccaatataagaagtggagcatgacaactgtagtacacatggtttttactatatttgtattttattctattttcctttaagagataatacgagttggagttatattcaatatttcctttactttttaagaaacttttaagattttaattagtcataatttctaggaagttgcaaagaaatctacagagagatccagtgtacacttcacccaacttctcccaaatttaacatcttgcataactgcagtacctgattatgaaaagcaggaaactgaccttggtacaacccacagagttattcggttacacgtgcactcgtttttatgtataagtcattttatcatatgtatatttctgtgaaacttccatcacaactaagatatttaacttattaaataatacgccaggcagagtgattgtttcacatttttatatagatgaggagtattttaaaacacttattttctttctgtaacttttccatctttgtcatttgtggttgatttcttttcctcagtgatatttgtgtttcagggttttcaatgaacaataatttcaatgaataatttcagtgaataataatttatttcacaaaaagacatcatagggcacacagatggtatggttgtatctatattaaaagactttgaataactgacatcaatagtgtatttttaaaactcacatgtatactcatatttcacacttaaattttccagttaaattcctaagtcaaaaatgaagttcgacttctgcttctgagaaaactggagtaggagcaattctgcttcttcctcccacttaaatgcaacttaatatcttggacatcacatagagaaaaatgtataaagacctagaaagggagggagaagacagcccactcttagggagctcagaactgggaaggacatggtggcaagagccctggtatttcttatttgcctcacatattccagttggatagaaacttaaaatccctccgttattctagttccttgttaagtaatacattgattaacctaccatttttagatttttatttacttcattagctgtagtgaactcttctttggactgtctgtgttttggtttgtagtttttatttgatttcttcatttccctcacagtgttaagttaaagcctttgcagaggtcccaactaggagctgagtgtagtggcttgcacttgtaatcccagctacttgggtggttaaggcaggaggatcactggagccgaggagttagaggctgcagtgagttatgcactgagtgttcacccactgcactctagtcttgatgacagagtgggaccccatgtgtaaaataataataatgaagtaaaaataaataggtaatcgtggaaatgagggtggtaaatatgtaaacagaagactcatctagccattgaacttcctttccctttttgctcttcatatttgcacctggggctgtgagagtggtactttggacattgtgttctagttctaatgtctgctcacctctgtggctatagagaccaggagcggaccagcctcagtgacgacagcatgttgttctttaagtaatgttcctactttcacacctcaacattggtcctttggaacaaggttacattttttttaattcaagaggcttaatgtatatttattatttcataaataaaacccacaaatacatctatataaaataaataaatggagaaaatcagattagtctaaaattatttcacataaaataactaaggaaacaacctatgaaaaaacttaaaagatatgataatgattctagtgcaattaacattattttgacacaacatctaattctgaactccttatcatgtaaattaaaaaaaaatctggaatcacatgtatgacatatgtggggatacagtaataatagagtgaggcataagatttatctcgtgtattggttatctattgctgcataaaaacatgtagcaaacttagtcatttaaaatagtactcttttgtttcctcatagtttccatagccagaagtgcaggcatgacatatccagattgattctatgcagtctcacaatgctacaattgtagtgtcatccaggctgtgtttgcatctggaacttgggggttctaccaagcttgtgtaggtttgtggcaaaatccagttctttgcatttctaggactgaggtccccacattcttgccgcttgctggccaagggctgctctgggttcctaatgggcacctcctggaggacttgggcatgcaaccatctccacagggcagcctccctcttccaaaggcacaggaggatctgtcccagcttgatcctctgaccctttgtaggagctcccacctgatcgatcaagtatggccacccagttaatctccttcaaactgattaattcaaaattgactgatttgggagatgacagctacaaaatccttccacctttgtcatctgatggaatcttagaacaggagtgaaatccacaactgccacaagtccagtccacagccaagaggcatttcaggggcaagaatctgggggccatctgtattagtcagggttctctagagggacaggactaataggaaatatacatacatatatatatatttccttttacatatatataatgggagtttattaagtattattaactcacacaatcacagtgtcccacaataggctgcctgtcaactgaggagcaaagaaaccagtttgagtcccaaagctgaagaacttggagtctgatgttcaagcgcaggaagcatccagcacaggagaaatatgtaggctgggccgctaagccagtctagtcttttcatggttttctgcctgctttatatcctggcaaagctggcagctgattagattgtgcccatccagattaagggtgggtctgccttccccagcccactgactcaaatgttaatctactttggcaacactctcacagacacacccaggttcaatactttgcatccttcaatccaattaagttgacactgagtgttaaccatcacaccatccaagaattattcctagcacatctcacaagctttattctggttaagggttctcgacttagctgtgcttcagattttgagggagcttcttaaaaatgcatatttataggcctctatatgaatctgattcagattcagaattgaactctatctcctcagttataaatattattttcaataagctacagaagcaatgcttatggagccagcttcatccccttgagacttctgataaccactgctctattaaatataggcatctcacctgcctatcattgattaaagtatggtattttcaaaactacagttgagttcatgaggggccaagtaacataaacgggatctttaaaaactaaatgacaaaggcagaagcaccactctagcctctaaaattagcaatctgttgctcaagtcttcaattacagtatgttttaagaggtcagcctgccccccaccaccataaaactgagttaacagctaagtctcataaaaaagtaatcacttcttggcattaaatcaatagaccattcctcacaatgaatgcttttaaatattatcactaatttaaacttggagtctgattctaaatttagatccaagtgctacctactggcaaatgaaatatcctctggtactccttttgaagtcaatttccccaaagtgtgttctacagaacttaatcttgtggcattagtcatttggaaaatattacctcatttggtctctagataatttacagggatttgagctattcctagaaattgacaagaaagtgtggaaaattgtgtatgatttgagtgtaaatagcagtcttgtcttcctcatgggtaaagtagatacatttcggtgtgtagatttcatcacttctatttttgaatgctcataggacttatttttttttatttctgcatctagactgctctccagaatgttgagattgcccgagaagtgaccccagcaaaagaaaaatattgctgtacctaaattcaagtaagaccattactttgcaataacgtatcatgtgtaaattagtggaaaaaatcaactgtattagtctacacttctaagagacaattgttttctttgatattaatctttttgaagcttctttctctgttcttgaaaaatgacaaaaaaaaaaaacaaaacctcttgttatggaagcagtagaaatattcagaacgtatctccatgtttagttgtagttacacagcattttgatgtgtctttccacaatgtttatttaaacagctatgttgaatttgtgttgtttctttaataagcactatttataggaatgagaaaaatcatttagtttttcaaaaacaccctttattaggtgagggatctgtgtctcttcatgaagatggtaactggagttacacatttcagtgagctgcgattttctgagaagggcagacactcaacaatggggagtgggttgcgatgcttggcagggtgactataaactgtcacgttctcttttgtttgttcagaggaaggagtgaatgaggtgaaattagtacaatgaatcaaattccttcaggaagggagtgtgagtcagcatgggtgatgcaggtggatcaatgaccttgtagtagaataagtgttactttaggaaggaatcatacactatttgttggaaggaggtgaacgtggctagaaaaggttaggattgaagtcactaaatctatttttataataagctgtcacagtatttttgatagcttatgtccttacagtccaaggacttgtagtatggctttagtaagattcatcaaactcactgatatatgttgggtttcaatgagtgccagtactgaaaagtatactgtgtgcatatttatgtactcaattatacttaaatgtagtgtagaagtggcaagaatctttgagtgtatcatgtgttataaaaaccatgaaactttataactttatgtagccatgcagattgcctattaaagagatttctaggctgggttttcaaggactatggcaagttctgaggcactgaggattaagcaattaggcctcaaagttgtcctgtttgctacctattctgttagacatggaagccacattgtgctgtttcttgtcatggatgggttgctaatagattgatttccctcacccaatctgatccttaaattattcaggtagattttttaaacaattatctttttaaaaaattttactttaagttctgggatacatgtgcagaacatgcaggtttgttacataggtatacatgtgccatggtggtttgttgcacctatcaacccatcatctaggttttaagccctgcatgcagtaggtatttgtcctaatgctctccgtccccttggccccaactcccaaaaggccctggtgtgtgatgttcccctccctgtgtccatgtgttcttgttattgagctcccacttacacatgagaacatgcggtgtttggttttctgttcttgtgttagagtgttgcgaatgatggcttccagcttcatccacgtccctgcaaaggacatgaactcattcttttttatgcctgcatagtattccatgatgtacatgtaccacattttctttatgcagtctaccactgatggatatttgggttggttccaagtctttgctattgtgaatagtgctgcagtagacatacgtgggcatgtgtctttatagcagaatgattcctaatcctttgggtatatacccagtaatgggattgctgggtcaaatggtatttctggttctagatccttgaggaatcaccacactgttttccacaatggttgaactaatttacacttccaccaacagtgtaaaagcgttaaacagttacctttaaattaaacagtgtattttcatcattcatgtaaactcagaaatttccaaagcacattttccccaaagcaaaaataaccctttctaacgcattataaatgccattatatacccaatgttttcaagttatttttcattgctagaccttttttcatagttaaatatgtacttcaaataaaatctcataggggagtccaacagataaaagaggaaaaaagaagcattttttaaatttttttatttttatactttaagttttagggtacatgtgcacaacgtgcaggtttgttacatatgtatacatgtgccatgttggtgtgctgcacccattaactcatcatttagcattaggtatatctcgtaatgctatccctcccccctccccccaccccacaacagtccccggtgtgtgatgttccccttcctgtgtccatgtgttctcattgttcagtttccacctatgagtgagaacatgcggtgtttggtttttttgtccttgcgatagtttgctgagaatgatggtttccatcttcatccatgtccctacaaaggacatgaactcatcattttttatggctgcatagtattccatggtgtatatttgccacattttcttaatccagtctatcattgttggacatttgggttggttccaagtcgttgctatcgtgaatagtgccgcaataaacatacgtgtgcatgtgtctttatagcagcatgatttatagtcctttgggtatatacccagtaatgggatggctgggtcaaatggtatttctagttctagatccctgaggaatcgccacaccgaagcagcagcgagtgatctagaacttggctgctctgtcactgccttcatttcttctaaatccattcccattccccaaacctccagactaaatggatattcatatttctcctgtgattccttggtttctcaatccttaatttggaagcacttgtggaagaatcaattgaaggggacagagagcaaaggatggaagctgaaacttccagaattattctgggctagccatcagtggccaagctgttgctgtgtaagagggggtcatttattcccttcttagaatttcccagtgtcaggggctgctctgcatgctttcacactaccattgtgcaaaggtttcaaagtatcatgcacagtaaatcctgactaaagcccaataagagtacaggttatacatgaagaaatggagaaaggcagttgtaaggaaaataatggaaattcacttgagggcggctattctcatcctcaagccaccttcttctgacaatcctgaaaagtagttaatattttgttattttttaaaaaatatggctggatgcatttcaagccgtcctctttcttaaatatatctctttgcctcttcatgtttaattcatgctcatatttgcccacatttaaagctaggctggcttcacattggaattgaaaatagccctaggagcatgaggaaccctgagagcctgggtgtcctcagctgtcacaactgggtacctgcccctttgtgtttgctgccctctctgcctggctagaggcggccccaggcttcctgggcatttttaaattactgaaacaagagtattataataaaacacttaacattttaatacatagtttttttttgctattgttgcttttgtgtgttttggggatgtctgaggcctctgcccttgactgcaattggtccttctgctgtggcctgcccctctctgtgtcacaagttgcagctgctgacaggacgcaacttctattgccccatgtgccaccagaatcattgttcaagctcccagtactctcagacagatttgtgattgaagaatcattgacttcacttggaaatcatctctatttctagtgttgtctgtcacagataaaatgacaaattgatcaaatgcaagcaagcttagcattcagcccagtactgacttcatatcctgggcaactttctgaattcattctgactgggacccactgcctatttctcttgtttcctggatctgactgcaaaagcttcatgtagggaaggcaggtaaagtcctcagctagggcactaatagcagtgaggttcccctagactggaaaaaaaagagtgacttgcatttgtttgcttgttttatgtttccaggaaagttatatgacagggaagaaacggtagtttctccttgtgatctcaggattaactggtgtaccacaatgtataaggtccaaatgaacatttcagaaaaattgatcaactgaagggaacatttctgtagctccattttgttcatttcaaagactctcttagttgagaaaagtctagctacacttaaaaatagtcccttttattgttcgtattgtctaccctagtaggtatgaagggacttctggaagttctcaagttcttggtattgctttccctcatgggcagattaatctaggctgcttcagtcttggtgattccatctccccctgttcagtcaagagaaggtgggactgtgccgtgcaggtaaaggccattggcagcctctcaggactaaaagtgtgggcctgtatttgtgtttgtctgtgaagtagagtcacaagaaaatctttaggtcaccatcagacaactttggtaatacagggaaaagcaaaaaagtctcaaaaattattctcataaatcttgttgtgttaaatgctgcttatagtatcaaagctgcagaacagaattacagaaactctggagcatggcagctgaaatggtggagagaggtagtgtctccctgagagtgtggggccctcttgttcatatgactttccacatctgctcagtcctgccttctttccaaatttcaggtgtcttccttgccttcaggctggattactcctagtgatggctctcactaccccatggttatcttgtgtcagctgcagtcagtgcctcattcccgaacatccctgcttgcctccctctgtcctggatgcaaaagccaatcttcacttcaacctcaactattcccacggaggaggagttacagctgtacagtgtctgctccaacccgtgggacacacagagaccctggtttgctcagagaggctggttacagccagcaaaaagcacagaggcaaatgttaagaggcaaacgttgacaagtgaaacaggagtgggctggcttcatggaaacaaagacttacttagccttataaggcccctgcatacacagccccacacttaattgaacgctttgacctctttaacacttgtttaatttgcctacattcaaatgagtgctttgtgttgcagtgttctatgggtctgacaaatgcatatcatggaaccatcattacagtgtcatgcagaggagtttcaccacccaaaaatatcccctacgcttctcttatttaactctcctcattcctgaacccctggaaaccaatgatcttttcactgtctctaccgttttgcattttctcaattgtcacataattggaatcctacagtagatagcctttcagaatggcttccttcacttaacaaaatgcattttagattcatctatgtctcttggaggtttgatagctgatttttttcctaaaaatatggcattctgtggtatactccgatttatttattcattcgtcttctgaaggcagttacaaatacagctgcaataaaaatattcagaccttacataagctttcaaatccattggtaatgcttagtagcataactgctgcatcaagtggtaagctctgtagggaattgcaaagctgttttccaatgtggcaaaaccatttggcattctcttttttgccactgctgtcttctccttcctctacctctccctctttccattcctctttttcttcttctggtctcttcctcctctcttttttttttttctgtcactttctgtctctctcttcacacacgtgcgcgcgcacacacacacacacacagggatagtttaggaaattgttggaggttatctaacatgttagttttgaaattaacaagttgggaaaggccattatagacaatactaattaatacaaatgaattataaagagaagatacaatatgaagcctcttcctcaggtcccagtattagtcaatatcttcctctatttatctgcaaaatcaaacctatagttgtccatttctttcttcttgaacttccaggtgtccatgaattctataaccatcagctctatcagccttcttatgcatgttctgttcattatttttgttctttatcatatcgagatatatatttgcctcatcctataatctcacctttctccctgatgttatctctgtgtgacactctgccaaaaagacacactttcccttactaaaacgtttcctattttgatgtagtcatgcttgcttatttttacttttgctgcctgagctttcaatgtcatattcaaaataattattgctaagaccaatatcaagaaggttttccccatgttttcttctacaaattttactgcttcagatctcatattgaaatcatcaatttattttgagttgatttttgtgtgttgtataagagtccagtttcactcttttgagtactgattcccagttatcctaatgtcattgtgtcttctttgtggccttcccaaaattagttgaccatgtatgcttgggttgatttttgggctctctactctgttccattggtctatgtatctgtttttatgccagtaccatattgttcttactactgtagctttgtcatgtaatttgaagtcaggaaatatgataccccaaactctgttttcagctttcaagatctcattggttatttgagtctttcagggtcccatataactttagaatgtttttctgttcctgtgaaaatgccattgaaattttgactgagattgcattcaatctgtatatggctttaggcagtatttgacattttaaaaatattaaaactttcaagccataaacattagttattaaactaaaaaacatttgcatggaaaaggaaataatcaacacaataaaaaggtaatctatggactgggagagaatatttgcaagctatacatctgataagaaattaatactcaaaatacataagcagttcccacaacttgaaaggaaaaaagtaatctaattaaaaaagggcaaaatatatgaatagacgtttttcgaagaaagacatacaaatagccaaacatatgcaaaggcattcaacatcactaattatcaggaaaatgcaaatcaaaatcacagtaagatatcactttacatctgttaagatggctataataaaaatgacaagagataagaggtgtcagcaagggtgtggagggaaggaaacccttgtgcactgctgctgagaatgtaaattggaacagctattgtgaaaaactgcatggagttttctcaaaaaattaaaaacagaactactgtatgatccagctatcctactgctggttatatacccaaagaaggtgaaatcagcatctggtagaaatatctgcatttgtcttttctttgtagcattattcacaatagccaagatattaaaacaaccctaactgttcatagatggatgaatggataaataaattatggtatatgtacataatataatactattcagtcttaaaaaaggacatgctgacatttgcaacaacattgttgagcctggaggatattacactaagtgaaataagccataaacagtaagacagatactgtattatttcacttatatgtggaatcttaagtcaaatacacacaaacacagagtgcaatggtagttacttgggaggagagggtgtggaaataaagagatgggaatcaaagagtacaaacttgaagttatataggatgaattagtctagagatctatggtacagcatgaggactctagttcataatactgttctgtatactggaaatttctgaagagagtagactttaggtgtgcttaccatacatacaaaaaagaaagtaataaaacgtcttgaaactagatagaagtaatatttgcacaatgttgtgaatttactaaatgccactgagctatatactttaatcaattttattctatgtgaattttacctcaatgaaaagaaatgcaagagaaaatgggagaaaacagacttcctattatacaaaacccaaacataaatcccaccaccttcaacacattttttttaggtggcccatcctaattattccttttctatctttctatataatagcattttagattaattttgcttgcgtttcccaccagattgtgaagcctttttttttttttttttttttttttttttaacaaagttttgctcttgttgcccaagctggagtgcaatggcacaagctcggctcactgcaacctccacctcccaggttcaagcgactctccggcctcagcctcccgagtagctgggctaacagatgcacgccaccatgcctggctaaatttttttgtatttttagtagagatggggtttcaccatgttggccagtctggtctcgaactcctggcctcaggtgatctgcctgtttcagcctccctaagtgctaggattacaggcgtgagccactgcacccggcctgtgaactcttgaagagaagtcttgcattactccattgccaagagtacttctccctcctagtcacttcacacagccctgtctgaactgtgctctccaggccagcattgttggtggtgattgctctggacctcacttttagttaacttaatctgactcatgtcctatgcttttacacatgccccatccttaaaactcatttctttgtaccttgtgtgtctcagatcctgcatctggatatttggacttgatctttgtttttattttcctaatggagtttatcataaacttgactgtagttttattaattgctttaatataatttcagccttcttgcctttccaaaaacttattctccaaaaacaaccatttggttagcacgtgcatcagtcctacctccatgaataggtggggaagggcagtcagcagagtttttcaggtgctatttctgggctatacattctcattttataaatttaattgggtttaactggtacttacaatatttatgttttcaacaagttattttgagtatttaaggaagaaaataacactagtataatgtatactgtgataatatttaagggatttcatttttatttttaactgtgtaattgctagtatgcatagaaaaatgatgagaaaatgaagcaaaatttaatctgttaacatttctcagtgatggatagtaacatgtacaaagttatatgcttttgaaatgtgatattatcttttattctttaaaaagttcaatttgggctttgctgcatattatttcttaatatgtagaaaaaataagaaggaaagctattgattttcctccagtatgaaagaaaatcaatagtgcaagaagggccaattgaccaagcaaagaaacagttcccttgaaataaatgttgtgacagaatacaataattattctgctatttaaaaaccaagccagattttcaaaattattctacacttctttgttacagtatataatgtatgaactcaatggagcaagtggtgatatcatattaagaatataatattattttctaaagcaagatcaatacgaagatctattttagaagagtgtcatttgcagcatgagcaccccagtctaaatgcctaagggttgaagaggcaaagaataacacatatataataataacaccagtcaagtttatgcctttttaaaaatgagaatgcaccattcagctttgatatagatatggtgggttcttttattgccgattgcccttctccaaagttaggtggtgagataatggcagatcaacaactgtctcttcaggtttttgtcaactaatccaaatatttttatgacatgacattaaaccatttttatattgcagggtataaacactataagaaataaatctttagttgagtaacatgtaattagtaagctgaaagagataaataggtacaagatgcatgttactaaataaaatatattttatgtttatgagtacagatatcctaatatattagttataaaagtagccctatttgcaacaggaagcattttttcaagaaaaaaatgtgatttggcacgtgcgtgtctgtgtgtgtgcgtgtgtgtgtacaccagacatctcttaaaagctacttcagattctcttaatttcatcttttttggtcacttcttccagcttcagccactactgcagtggtcaagtttctggagtttgaaaaaaatttatgcaagcacaagtgaccagctcttcatcttaaacctgcatcccatatcactcctcttttttcttctgcctggaaattttctattgagatgaggcacaaacaaatgctatggaattaattgtccatgaggcaaatctctgacaacctggagactagagccaataaatatattattctcccctttatcctcagagacaccatcccaagatgatgtcactgatgccgcataccaagtggtggccaactttacattacatcctctcacggtttgccccaactgactgtaacgcctaatctgacccattctgttaccttgctcctccttgcttttcctgatctccactctcttataaaccactactcctttgctaggcatttcatcagaatgcattgcttattttcatactgatgacatcaacctggtcactcctgctcatttactcaaggttttagtgtttgactaacagtgtttctctgcgctatttctgtaagtcttacgcttccgcattcacacagaagattaattccacaccctggctttcagtgctatgctgcttccctctcagctatttgtgcatttgtctgcaggtgcccattccctaaactgtatgattgcctgtgactgtaccgtctccagagtctccgttttataactctatatcccattttttcagcccacttaccttagttatcctattccagactaagctgaagacttccagtcctcaaccctttaccttcaagtgcccatagcacgttatggcttcattccatccttatacaacttatattccataatacatcagtataatcaccatttacataccttcccagcgtttttgcctttctctccttcccacagcacatctggaaaaatcttaaccataattaaactaaatttctatctgcttccccaagtagcaaaatatgactcaaagaaaacatacaactatgctgatgagttcgccttcaacttgtgacccccaaacctcagcccagtcatgactcttacttatgagtcatcatttgtctgaatttgctatttatatctattttctctccaaactttcagcaaatgtcttttatcgctgtatttaataaccttgccttaactttactactatagcagcattaataaaaaaattacttatctattaagaaaatctaccaaactagctgcatttattcccgtatcccttcttactatgaaggaaatgtatatgctcccatcttagccaaaaatccttcacttttacattggattccattttttttccacccgcttaaggactctgcttctgaaattgtatcttacttattcaagtatcaacagtttgtctctctctgcttcatttgtctatttccattagaatacaaatatggttacatcttttttattattattattattttttgagatggagtcttgctctgtcgcccaggctggacttcagtggtgtgatctcggctcactgcaacctccgctgcccagattcaagcaattctcctgcctcagcctcctgaatagctgggattacaggtgcccaccaccacacctggctagtttttgtatttttagtagagacagggtttcaccatgttggtcaggctggtctccaactcctgacctcatgatctgcctcccttggcctcccaaagtgctgggattacaggtgtgagccaccgtgcccggcctacatcttaaaattaaaaataaaattcctcctttaactccacttattttggtagcttcagcctgaaatgtctgtttcctgcaatctcaatctcttttaaatggttgtaattatggtatgttttcaaatcttcacattttagtcacctttgaaactattacaaataggtcttaactcagcattccactgaaaccattcttatcaaacgagccaagggaaatttaatatgtgtcccagtgagtttacccctgacttgaaatatctccgtcattcagattcctttttaatggttaaacaatagatattagtgccccaaatgtaaaaacataaggattggtatatttttgaggaaaaaaaattaaaatgttcctagttcagtattaaatatcctttttgtggtatttaagtattattgactttgtaaatgacagttatttattactgtgaagattctcaatatttttataatataaaattatgattgttcttttttaacaaaacaaagaaaaatttgagattcttcttattcaaggttatactttctgacattgattcctctgaagatgacaaatgtcttcacaaggtaacagtgttttataatatgcttagaaaatagaatcaggttcatatggtttgcatctatgtccccacccaaatctcacattgaattgtagtaatccccacatgtcaagggcaggaccaggtgaagataattgaatcaaaggggcagtttccccattctgctctcatgataatgactgagtctcttgagatctgatggttttataagcatatcacataacccctgctggcactcattctctttcctgttgccctgtgaagaggtgccttctgccatgactgtaagtttcctgaggcttccgcagccatatggaactgtgagtcgattaaacctttttctttataaggtatccagtctcaggcagttatttacagcagtgagtgtgataatggactaatatacatgttgtgttaaaagttgtccaaagaaatactgcttaggtcaaaacctgatgctgccatttactagttgtgactcatttgacagtttcttaaactctctgagtaagttcccacatagaccatactgctatgataaatataaatgtatatgtgaaaactgcttaaggtcatatttatcagacaatataagcaaataatatatgttaattggttaagagaaatcacacctttttttactttaaagttcactaataattgtggaaaatattcttttttctttttcctcatcaaacttttatctattaatgtacatttctatgaattcatttttttctatattatacaatggaagataatataacactattgttttttattttatttatttttttttaattttactttaacttccaagatacatgtgcagaaagtgcaggtttgttacataggtatacatgtgccatggtggtttgtttgctgcacctatcaacacgtcatctaggttttaagccctgcattcattaagtatttgccctaatgctctccataccctagactcccacccccgacaggtctgtgtgtgttgttcctctccctgtgtgcatgtgttctcattgttgaactcccacttaggagtgagaacatgcagtgtttggttttctgttcctgtgttagtttgctgaggatgatggctgccagcttcttgaaccatgtccctgcaaaggacatgatctcattcttttttatggctgcatagtattccatggtgtatatgtgccacattttctttattcaatatatcattgatgtgcatttaggtaggctccatgtctttgctattgtaaatagtgctgcagtaaatatatgtgtgcatgtatctttatagtagaatgatttatattcctttgggtatatactcaataatgggatttcctatggtcaaagggtatttcttattctagaaatcaccttaattcaaatcaatcaaagtccttgaggaacactgtcttccacaatgtttgaactaatttacattcacaccaacagtgtaaaaacattcctatttctccacagcctcgacagcaaatattgtttcttgactttttaataattgttattctgactggtgtgagatggtatctcattatggttttgatttacatgtctctaatgatcagtgataatgagctttttttcatatgtttgttggcggcataaatgtctttttttttgagaagtgtctgttcatatccttttaacactttttgatggggttgttttgtttttgttttgttttgctttgtttgtaaatttaagttccttgtagattgtggatattagacctttgtcagatgggtagattgcaaagattttctcccattctgtaggttgcctgttcactctgatgctggtttcttttgctgtgcagaagctctttaattatatcccatttgtcaattttggcttttgttgcaattacttttggcatttttgtcatgaagtctttgcccacgcctatttcctgaatggtattgcctgcattttcttccaggttttttatggtttggggttttacatttaagtctttaatccatcttgagttaatttttgtataaggtgtaaggaaggggtccagtttcagcccaaagtaatttataggttcaatgctatttccgtcaaactgccactgactttcttcacagaattagaaaaaaactattttaaatttcatatggaaccaaaaaagagatcatatagccaagacaatcccatgtcaaaagaacaaagctggaggcaccctgctacctgacttcaaagtctgctacaaggctacagcaatgaaaacagcaaggtactggtaccaaaacagacatatagaccaatggaacagaacagagacctcagaaataacaccacacatctacaacgatctggtctttgacaaacctgacaaaaacgagctatggggaaaggattccctatttaagaaatggttctgggtaaactgactagccatacgcagaaagctgaaacaagaaaatgttatacttacatttttgtttaacttttacagtatctttgttaaatagattatgtgcttgggcccattttatagcttatagaattaaaaaaataagcaatatcaaactgcacaaacccatacatatataaactcaggatgctattgttttagagttttcatgagcataaaccaatggtcacatttcttttgctctgagatgaggtccatggtcagaaacaatactacgtacaatgccatgatatttgaaagggcattttattagttcatggatggtaattttgcaaaagcactgtaatcagggaaagcaaatcaatacctgtagtaagtattccactatgaacaaagctctgcccttccatgatggaagtggcccagtgaaaacaaccaggcagctggctgatcacccaggaagtggttccatgttagcagggactatatccaaatcagcccaggtgagtggaagacagtgtttttcagcacatacatattatccatcactgccaccttagccactttgtcaccagccaatacttggatatgatagtaatggctggtgaaagagcctggctgacatcaacagaacaggccattctattttcattattaaaatattggtctactgaatccacttattgacaatcattctcaaagaacacgaatatctttatggtgttccattcagtgaccattcagtgaggtctacccacatgctccttccctagacttccttgccaccaatattccaatcacgtttcttcaaatagtgaaccatacaggcaagccattggcttcagctcatgaatcattgtagtcccccatctttagccctctctgcttccaggcaaaatgaacaaccaggtgcactcatccacgttctgcccactgggaggattttcctttgcgattgtcttcaggaagaccctgtaggtgtggggctgcagtattgcagctgcccatctcagacagtacgtgcacatcattcagatccatttgtaaactacacaagagttttttcaccctcagatagtcatagggtactctcatgtgggttcaggtacaagctgagagagaaaaagcagtgtagcaagagtaagagccatgcacatttgggacacctcttcatgtaactttcctattccttcaaggtgtgcctgagtccactctggtaaacaccacttccatttgataatggagtactgcagtgcacacccaactgtgacttttgggggcaaacaatacacagttcacaatggactatctattaagtccctgtagcagaccaaaatctgtttctcaaaagcagagtagacgttcactgaggatagtaaggccttgatcccaaatcctaaaggcctgcactgtgactcacctgtagcaaccctctctgccactgacatttcaagttccctgaggtgtactctatcatgaaacccaagaggcagagcagattgcatagcagcctggatctgttcagagcccttttgtgttctgggcctcacccagcattagcaacttttgagtcactatgtaaatgggccagagaagcatatcttaatgaggtacacacttcctccataatccatggaggtctcacaggaatagcacaaaggtggaaaaacaacaacttatcctttacctagacaaggatattttgacaatctccaggccactgggccgtggaaactttgaaagacacataattaagccatcagaggtattatgaatttaaggatgaaattaatgggatagaaatatagtactttttattgttatcctatgtcattgtttatttttttttcagtagtctttgacatcataaagcagtggttctcaaaagtgagcatacaatggaatcacctggatatcttgttaaaactctggttgctaggccctaaccccagagtttctgattcggtagatgtgggaaggagcctaggaatttgcaattctaagttcccaggtgctgctgatgcagggaccacactgtgcaaaccactagatggagaaagaagtggatgatttatggtagaaagcaagttataagttgactgtaatatgatttgtccctgataactctctgttttgtttctgaatttgttctgtgggtaaaggatactctgtgtaaaaggaaagttaacaacattcaaactccaggtaccaagtctgctgtaagaccacacagacctctgtgtcaagcctccttgtgtctaggtgctgcatggcatttacacagcagaacagaacatttaatacatttcagaagagataaacattttagtataaatatttagtattttaggcataaaatatagtgtttttcaaaaaactataaaaatagagataggattttaacttgatttcagtagcacatctaataattgaacttttttgaatcccaattctaaattctaatctaagttaaattctgatctaagttaattcttctctagaacacgtttgagtgaagattattttgtgaacaatgggaagacaattgcttgtgttatagatattccctattttctgtttgaatgttgattactcataagtcatttggtagctttcattcatttattaatccattaaacaagcatgtactgaatacctgctatatactaggttatctactaggcactggaattcaaagatggatacggtataattcagcctttaaggagctcacagtctactgtaactgagtcttctcagagaaaggccagcattctgcttctgattctttctagaacaatattatatttcatagaatatgatatttcatgcaaaatacagctgttaaccatatttttatagttattacctccctggattgaggagaacagtcagaacaaaaggtggtaatatttatatttcatattttctgcttttaagattatatttcagatttattttcactcaatgtgcccaatttaagtctattgttgataacattgataacatcagtaaggttatgactttgcaatcagtttgaaatgcatagctccagttgatttaaatgatttctctttgagaaaaaaaggtaatgaattggccgtaactaattagcatgccataaatcatcacactggtgttcttttctacttgaatacctgagaaaggtatactaacagaaaatactctctttctctttttttaagtgtttgctagtgccttttagaggtaaattgtttcaataaagcttcttgcacacacttgcagaacctttgaaagccattttactacctcctgttgacaaacagcaagatcctccgcacatcacagaggtgacatgcttggtcatttgggggtggatagtggaactggttccctgtgaggaagcagccacctgttcactctttcagtaggtgaagcaaaacagctagagcatatgaagaaacaaggtggaatgacacgacaataagaataaattgggcttagatagaatggtgcaattatgctacaaacagcttgcctttcattgccataaattatgccgggttatagtattattttctggataagcacttcgctattttttctttcactggtcttctttttacattttaccattcagaattctctattttcatcagtcttgccatatatcatacttacgtagccttctgaaagctccaaagtttatgagacttttatgtcaaatatgttaggctgggttttgtttatttgttatttatattatgctgtggtgtttctgggataaaatcctctctgtcctcactataagcattacatacagccatttggtaatggtaagaaaactaagattttattgtaacagatattttatcctttttttggttcatcagaagcagtattgaagggcaaaaggagaaaaatgcttggcaaatcgttgctaattttgaaatattgggttatcagcataggatgctctaatatgccaggtgaatcagtaagtagtgttccattgattcacaagagcactactggaaatagttcggcaaatcatttgcctcactatctttggttaatcagctgtaatttatgttgagaaacaatcctctaatacagaattatgaggggaaactgttcttgttttttaaaaaaataaactttaaattctgggatacatatgcagaacatacaggtttgttacataggtatacacgtgccatgctggtttgctgaacctgtcaacccatcacctaggttttaagccctgcatgcagtaggtatttgtgctaatgctctacctcccctttctcctcaccccacaacaggccccggtgtgtgctgttcccctccctgtatccatgcaaggaacgtgttcttgagatgagactggtgataccaatcaccattgaatatttgtcctctcagtatattgtctcagttagcctatgtatgatgggacaataaaagggagaatttcatggtcaataactcaaaagcaaatgtaataaaaacaaagaaaaatagctggggcctaattaaactaaagagcttttgcacagcaaaagaggatttccaaatatcaccatattgtttttacctttccgtgtttactggacttcatggagtcagagaagccacagagaaggcttccgtgtggcctgatttattgagagccctggtgtgcccagtgggcatcccaccctgagtgcagcacaagaaagccaaatctccaaaaagcttttgttgttgttttgttgtttgttttgtttgtcatatctttttaaaaagaacaaaaccagaagcagcttggtattatcagattccactggcctgggatgttggagtctctggctcaacaactcatctgctttttaggtttgagaaatttacttgctttctttggtccttagttttttcatctgtgaaataaggaagttaggcccattttgttgttacaccatcatgtaacatttccctgatcattattgatgttgagcatttttttcatatgtttgttggccatctgtatatcttcttttaagaattgtctattcatatccttagcccacattttgatgggattgtttgttttactgatttgtttgagtttgttgtagattgtggatattagtcctttgtcagatgtataggttgtgatgattttctcccactctgtgggttgtctgtttattctgctgacattccttttgctgcataaaagctcttcagtttaaataggtcccagctattttttttttttaattgcatttgcttttgggttcttggtcatgaaatccttgcctaagccaatgtctagaagggtttttccaatgttaatttctacaatttttatagttttaggtcttaggtttaagtccttaatccatcttgagttgatttttgtataaggtgagagatgaggatccagtttccttctcctacatgtggccagccaattatcccagcactatttgttgaaaaggatgtcctttccctgttttatgtttttgtttgctttgtcgaagatcagttgactgtaagtatttgggtttatttctggattctctattctgtttcattggtctgtgtgcctttttttataccagtaccatgctgtttgggtgactatggccttatagtatagtttgaaatcaggtagtgtgatgcctccagatttgttctttttgcttagtctgctttggctgtgtgggcttgtttttggatccatatgaattttataattattttttctaattctgtgtagaatgatggtggtattttgatggggattgcattcaatttgtaaattacttttggcagtatggtcattttcacaacattgtttctacctatccatgagcatgggatgtgtttccatttgtttgtgtcatctacaatttatttcagcagtgttttgtagttttcctcatagaagtctttaggctccttaggtatattcccaagttgtttttttgttttcttatttgtttgtttgtttgtttttgcagctatagtaaaaagggttgagttcttgatttgattctccacttggtcgctgttggtatatagaagagctactgatttgtatacattaatcttgtatctggaaactttgctgaatccttttatcaattctaggagctttctggaggagtccttagggttttcaaggtaaaggatcatatcatcagcaaacagtgacagtttgacttcctctttgccaatgtggatgccctttatttcttccttttgtatgattgctctgactaggacttctagtactttgttgaagaagagtagtgagagagtgcatccttgttttgttccagttctcagagggaatgctttcaacatttccccattcagtattatgttggctgtgggtttgtcctagatgaccttcattaccttaaggtatgtcccttgtatgctgattttgctgagagttttaatcataaagagatgctggattttgtcaaatgctttttctgcatctattgagatgatcatgtgatttttgtttttaattctgtttttgtggcgtaccacatttattgacttgtgtatattaaaccatccctgcatctctggtatgaaaaccacttgatcatggtggatcatctttttgatatgttgttggattctgtagctagtattttgtttaggatactagcaaatacattcatcaaggatatcaatctatagttttcttttcagttatgtcctttcctggtttaggtattagggtgatgctggctccataaattgaattagggaggtttccttcttcctctatcttgtggaatagtgttcaataagattggtaccaattcttatttgaatgtctggtagaattctgctgtgaatccatctggtcctggacatgttttgttggcaattttcaaattagcatttccatctccctgcttgatattgttctgttcagggtatctaattcttcttgatttaagccaggaagttgtatttttccaggaattactcatctcttctagattttctagtttatgtgtgtataggtgttcatagtagccttgaatgatcttttgcattccagtggtgtcagttgtaatatctcctgtttcatttctcagtgaggttatttggattttctctcttcttttcttggttaatcttgctaatggtctattaattttatttatcttttcaaagaaccagctttttgtttcatttattttttgtacttcttttggtttcaatttcatttagttctgctctgatcttggtaatttcctttcttctgctgggtttgggtttggattattcttgtttttctatttccttgagatgtgaccttagaatgtcagtttgtgctctttcattttttttgatgtaggcacttagggctatgaactttcctcttggcaccgcctttgcattagcccagagattttgatagattgtgtcattattgtcattcagttcgaagaatttttttacttcaatcttgattttgtttttgacccagaagatgactctttctagaaagcatcagctgtagtagtgtacagagagacaggcggtgggcagggccctagaactcacaagattatatgccccttgtcttctgctaccaggatggatagggaaggaccatctggtggggacagggctaggcatcactgacctcagtctctacttgggcagttcttgctgtggctgctgtggagaatgcaagtgaggttcccatgtcactggagttgtgtacctggaggactatggctgcctctgctgagtcatgcaggtcatcagggaagtgggggaaagccagcagtcacaggcctcacacagctcccatgcaaacctaagggctggtctcactcccaccgtgacccccacaagaaccctgagtctgtttccaaggagagggcatgatgggcttgaaaacttgccccgggatacctgccttccagctgtgaaagaaaagggcttggttcttcccccatctgtaaagtctgcacaccagatttccatcctccctggatttctggccaggaggtttctcgccccgttcaaattgttacaaaattcagctagagatttccttctccctgtggagttatacctcctgctcctctggtcaccctcccaatggatccctgttatgccaggcaagaatggcctgctaggggatgcggcaagctcccagggcctttctgcttcttcctctacccctgtatttcacttagctctctaaattgactcagctccaggtaaagtcagaaaggtctcccgcaaacagaccttcagcttttccactgggggtgtgtgttctggagagaagggtctccctttcccacttctgcagttgtatttggggtgtcttctgggtcctacaggagcagttcacttccttcagagggtctgtgggtcctctcagggctgttggtttgttcttgcagtcggcctggagctaaaattcacaatgagagtttgcgcaagctgctctgtctggaattgcaactagtcctgcctccggtcctccatgatgatgattcttgagatgagattttaatatcaataattttcatggggatctttatccatccaaacatatgaaagtggcttaactggagtaaatttcaggaattatttgggcttaatataaaaactatccttttatgtaatgtccttagtctgtttcacactgctgaagttgatggaattgtcccaggaaatcactgttgtataaagtctaatgattctctatctgagttgaccagtatccattagagtttttgacctagtgtcaaggcaaaagcacttaaataattgtcagaaggcctggacagaagaccctgatttgccattttatggctagcaactggtatctcgtaatccatgcaactgtctcagaattaacaagtacatgagattcttatgaaagcctaatgaaatgatttgtgaaaactgcaatgcacaatgaataatcatgattattaaagataaatttagaatatttgtagaagctgcctttaaactctctttttctcttctttaagccgtgtctacttttacagcaagtgtggatggttgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaagctgaggccggtggatcacttgaggtcaggtgtttgagattagcctggccaacaagctgaaactccatctctactaaaaatacaaaaaaaaaaaaacaaaaaaaacccaaaacctagtcaggcatagtgatgtgcacctgtaatcccagctactcaggaggctgaggcaggaaaatcacttgaacctggtaggtggaagttgcagtgagctgagatcatgccacggcactccagcctgagtgacagagccagattctgtctcaaaataaagaaagaaagaaaaattgaaagtagcatacagagagagaaagaaaacaggaatttttaaaataaaagataccactttgctactacttggtttattttcttgaaaagtaggaactggaagagtaccgaaatttagcaaaaatgattgttatttatttccatatttatttttctttgtggtcttcacttgcaaatagttgaattaatcatattatttggtctatggaaaacatcaccactggcctatgcaaggcccgcctgattatacatttatgtgtatgtgtgaatatgtaatatgtacataaagatatatacattcaaatacattcctgtaagcagtatttctgttgtctgtttacatacattttaggattgcatagtttattgtgctctaatgctttctcattctattgtacttttgctcagcatttttttaaaaacttgtctctgttaataggtgcaccttttctctatcttttagtttctcagtattgttctccagagattgactttgagattgcatccagggccttgtcatcacaggataacaccagaatgaatatccttgcatactttcccttgtgtgagaatatctttggaatatttatctgtgatctgactttctaagattttcacatgcttaaattttgtattgccagattactgtccagagtggcaagctacatatcactaaaaataaggatattctactttatcattttaccttccacattgaggtttctgatgcatctcgtttcaaacttggaacatggtgttatgcaggtacacagttttatcatttttccctagtagtaaacatgtcctagtaccgtcttctaaaccatctatttttcccgttggttttactggcatatttattatattttctttttttattttaaaaattatcagtctttattctcatatgcagttcaaacaatacaatttaacaattctaagacattattttcaattgtcacttataaattgaccattcttaaatctctctcttgtgttctgttggtgtccacttccctaccaatgtcattatatttatttccgtactttgcagtttatctgcacatttgtcttcttttcagaatgagccccatatcagatagcagcctgtgcccagagcgcaggtgaagtctcccatttgccgcccctcagcaggtgcatcctaggccagtgacttgactttagactcagaaaaaaacagcatctgattgggagggatccagctgggagaaagcagtctcccgggttgaatccgccggctctgaaggtggcagtggggagaagggaaataaatgccctttggcgacttgtcctgctaatagcgtttttcctttcctggttttatcatgccacaccatcagtttgagttgctgattatttctctggaaataggataggcaatcattttacaaggcaatatggggcaagtaaatcctgaagcagaagatttttctccagccttgacacagtcctcaggcagctacagagcccaaatctgttcctcaaatctacagggctctgcaagccctgatgatttacctttgtgacaggtgacagacactcaggaagttcataatagggaaggaggcagagtgattaacatcagcagcaaagtacagtaaagcatccatttcttttttaaaatgtcatactttcttttaattaacaacttgatgccttgtagaatttttaggttcagaagctagcaagtacagctatgaatgctacaattcaaggaatcacagtgtgtttccacaatcatttttccataccagccaatacactatgatcttggacttttttggcatcacaatcattaggaggttcaagtcttttcgtagagtatcaacagtatgaaagaaagggacctcaaagctaaaatccctgaattaaagtcctacttccagtgcttgttaaatgtgatcctggtcacactgtttttatttttggtggaagttgtaaatgaaatgcttacacagggaattagtactgaatatggttagcattatctcacctgggaagtcaggagcaaaagtaatgtcatcaggctcagatttggaatgcattctctgggatgaagacggtggaagatagtttcttctattctgtaaaagtttttatttttctttgcagtgtttttttttaaaatcacagtttcttgtgattagacaaaactgttgaatgttgaaacacaacgattaggacttaatttccttttttttttttttttgagaccaagtttcactcttgttgcccaggctacagtgcaatggttcaatctcggctcactgcaacctctgtctccccagttcaagtgattctcctgcctcagccccccaagtagctggcattacaggtgcccaccactacacctggctaatttttgtatttttattaaagacagtgtttcaccatgttggccaggctggtctcgaactcttgacctcaggtgatccacctcctcagcctcccaaagtgctgggattataagtgtgagccactgcgcctggcaggacttaacttctgatgtgctcatagtaaagcaaatcaaccaacgtggagttgagcccaaaattgtgttgaagcaattctgagaaatatgtggcaggacaagcagaccctccttgtgagtacagattctaggaaattatgacgacgctgagtgcaggtcgtcagctgccctgttttggtgcatgactgccttatctacaggatagtatggaacctggtggatgtagggtgcgagtcagccaacagctgttccaatcttccagtgggccttatcttagcagagagtgcaaaatacttcttgcacgtggtttcagtttcatcagtgatttgatctgtagggaatattgattctgaagtgaatgacatggataaagaaacaaaattagggaacctgtattgtgggtgtggattttagcaagcatttgggcgctaataggatgataggcaaggagtgcaattagctatttgtatcattcccccaacaaattggtttttcttttgagagtctgaataatataaatgcttaccttcatgtgcctacctggttgttttagaaaggtgtatgtgacataataacagcaaatattttcttagcccctgcttcctgccagacattgtactaagcactttgcatataatgactcactgagtcctcaaacaactctgtgaattaattcccgttagtatctccactttacactgaaaaaacaaggcatcaaaatgaaaataattttccaagggtcgcattgagcaagtgctggaagtggaagtgggactttatctcaggcagtttagctctgaagtctcctcacttaagctcctgaagactatgacatcagaaaatccaaggtcacaatgacttgagctgtggagaaagtaaatgatcatagaaacagacgttgattccttgggttgtagcattaatactcgaaactcaatccccagacttgggctaaaatgaaaagtgtagcaagcagaaatcttctctgtgtggaaagatgtgtacttgtaattctctgctctctcttaaaatctggcctgttccatccaggcgcttactgaacaaaatgccatctacaccagggatgcccttcctcaactctagtcaatttagtcaccagaagcacaagaggagcaaggattggaagcatttgagcaaggatacctcaactgatgacagacactagaaaggcaatttcagaatgaatcacgataaatgaaaaccaaataggcctctgtgaagggaaggggaatgatccatgcaatatttatacatgtgtcagtgatatttacagcaaactagggctaaaaaaagtaaaacaaaccaaaaaaaacctctaagtataaaaagaataaatttgatgtaaataaattgttgactttgttcttcacagtggctaccactatgaatccagtgtacaaatcttaatttattcccctaaatcagagaaggggcttatgttataaatcaaaggaggggctcattcattgtcttttgattttttattttaagcattaaaactttctctaacatcatggcttgctttgaggtatactgatggaatacttcatgaaaaaaacaatatgttatcaagtccttctcaagattaaaaactagaagtttaaaggaggtaacatacatcttatagccatgtgcccaggatcagacaattaataatgaagtttagagttttctcatttatctgtaattcccagaaatttaagtgatattttgctataataatgtggctgaaatctctctttttcctaagaaaactgaattcctttcactgtgatttttaaacataatttaatatttaaaactgttttagatttaaagaaaaattgaaaagataacacaaagagtttccacacattccacacaaagttttctgtattattaacaccttctactagtactgggtatttgttacaactaatgaaccaatattagtatgtcattattaactaaagtccatggcacatttttaaaatttattttacttttatggagcactttcttcctttctagcgctgcgtgacactccatgatcatcttgtttactttctgagttctagaattagccatttctctaaggagccttggtttattttactgaacactgatactagaaatcaggaactgggtgttatgtgtccttgtagctcttgatgtgcttttcttttagacaatctcagcaaacataagtgtgtatattcattggcttttaaacagatatttataaatatttttgtatatatccatttgtatctatattcagctaaacatgaattgataccaatgacctcaactctctaatctatcaccacctgaatcatttagcttcttcttgtctataaattttcacttcaatagttagaaacatggctcccaccatcaaacagccatttactgatgtattcaattctagaatacaagtatagcaatatgaggatttttaacccacgtctccatgggcaacacctttatcaaatacagcaccgttcttatgtgccgttctttttgcatttagccttatagacaatccttctttccagagttacttaggtcagcaccttttcttcccaaccccatcaatgaggttgtttcatatatttgtaatacagttagattttcttatcatggtctgaattccttcctgggatacccaatcctcctttttttaaatttgcatgtattaattttcactttatgttctgtaagttctatggtttttgacaaatgggtagggccatgtatccacaattacatatcatacagcacagtgttaatgttctaaataatctcctgtgcttccttcctctactctcctgtcctcccctccttcccctgatctctcttggaattactgctctttgtatcatctttatatctttgcttttccagggtgtgatataattgaaagcatacagtatgtagtctttttccaccgattctttcacttagcaatgtacagtgtttcctcagtgcccttttacggcttgatagtgcatttctttttactactgaatactgttctattgcacagatgacccacagtttttttatccatttgcttattaaaggacattttgatactttccaatttttggcagcagagaataagttgatataaagttatgtgcagtattatctatggaaataagttttcatttaatttgtaaggagagttaaagtaaatttaccctttttcttctaaaggtaagcattccctcacctcccattcatggcttctttcaagactttctctttgttttgtttttttttttttacagtttgaaaatgttatgtgtaggtgaatgtatttatttattattttactatttatactgctctgtgttctctgtgtattctgtttttttgttttgagtagcattaattttggaaagatctcaatgactattacttcaaatatttcttggttttgtctcctttttcttttgatattgtcattacacatatatgacagctttgaaactgtcccaaagttcttgggtacttcttctttctcctccttatcctcttatttttctccttcttcctcttcattatatattttttgctttttccatttcagttgggaagttcctgttaacatgccttcaagctcactcattcttttctttgccacgtctaggattctgatgaatccatcaaaggcatgtttctgtttcagagtttttcagttctagcattttccttgaatttttctgagagtttttatttacattacccatctgttcttccatgctgaccactttttccagaagtgttaactttagggctccagcagcccatcctccaggtaagacaatctcagctgtttctctgtgttcacctgtctctgcagatttcaggtgacagtttggcatgagacttcagttctttaatgggcccaagaaaagccattaactttcagtgcattcatattttttcttgttgtaaggagtggagtagctatttctaagattttttatacatcagacgtgaaagaaacatattgtattttttttaatagcagcatttcggctccttacttagtggttgttctttgtgtgcagaaaaccaagcgaaaaaaatgtgaaacatataccttttatttgggcatttgtaatggttctgaggagctgaaattgaagcttagtttcgtattaatacaaaatttcatccattgtactattattgtcattgctatgtggcagaattaaatatgtgtgtgtgtgtttctgtgtgtgtgtgtttctgtgtgtgtgtgtgtgttcgtaataaaatcttgttatatttgtactgaagaataatgtaagacttttagtataaaaataacaatgtaggatgactagaaataactgcaacgtcaatgcattttttgtagcaaatctatattttttcaacctaaaagttatgttgttattgatgagctctgtaaagggcaactctgcttttgtgacctgtcagttttataaggtgatgaaaaatgcataatgataccccctggaaaaatttagtagatacattttgtatacagacatagaatttagtgtaaattaaacaatttactaatggactgaaaaagggaatgggaatgtttgatttcctcaagttttggtggctaagagactagccatctaccttacagccctccgaagatatgtgccaagtaagatttattttcttcaagtgaagaacttttcattatttttctatttcataatatctccactctacctaggtctgtactagatgtatagtacatatcttttttttgtccagtaaatatggcactgaaatgaattgtagtcaacactcagtatctgggcatgaattatgttccaagtagattatcttgatcatgattttctgtcttttccttgccaatgtgtctgtaccttgccagacaatatttgtctggactagatatcttccaaataaactgcaagttcattttgtatagcatattaatctaggaattgcataaatgtaaatttgttgaaaatacatctttgaaaataaatttatttaatcttaaaataagatataaattttttattatacttcaagttctagggtacatgtgcacaacatgcaggtttgttacatatgtatacatgtgccatattggtgtgctgcacctgttaactcgtcatttacattagttatatctcctaatgctatccctccccactcccccaaccccatgacaggccccggtgtgtgatgttccccactctgtgtccaggtgttctcattgttcaattcccacctatgagtgacaacatgcggtgtttggttttctgtccttgtgagagtttgctgagaatgatggttcccagcttcatccatgtccctacaaaggacgtgaactcatccttttttatggctgcatagtattccatggtatatatgtgccacattttcttaatccagtctatcattgatggacatttgggttggttccaagtctttgctattgtgaatagtgccgcaataaacatacgtgtgcatgtgtctttataacagcatgatttataatcttttgggtatacacccagtaatgagatggctgggtcaaatggtatttctagttctagatccttgaggaatcaccacactgtcttccacaatggttgaacaagtttacagtcccaacagcagtgtaaaactgttcctatttctccacatcctctccagcacctgttgtttcctgactttttaatgatcaccattctaactggtgtgtgatggtatctcattgtggttttgatctgcatttctctgatggccaatgatgatgaacattttttcatgtgtctgttggctgcacaaaatgtcttcttttgagaagtgtctgttcatatcctttgcccactttttgatggggttgtttgatttttttcttgtaaatctgtttaagttctttgtagattccagatattagacctttgtcagatgggtagattgcaaaaattttctcccattctgtagggtgcctgttcacgctgatggtagtttcttttgctgtgcagaagctctttaattagatcccatttgtccattttggcttttgttgcaattgcttttggtgttttagtcatgaagtccttgcccatgcctatgtcctgaatggtattccctaggttttcttctagggtttttatggttttaggtctaacatgtaagtctttaatccatcttgaattaatttttgtgtaagatgtaaggaagggatccacttacagctttctacatatggctagccagttttcccagcaccatttgttaagtagggaatcctttccccatttcttgtttttgtcaggtttgtcaaagatcagagagttgtagatgtgtggtattattcctgagggctctgttctgttccattggtctatatatctgttttggtaccagtaccatgctgttttggttactgtagacttgtagtatagtttgaagtcaggtagtgtgatgcctccagctttgttcttttggcttagggttgacttggcaatgagggctcttttttggttccatatgaactttaaagtagttttttccgattctgtgaagaaagtcattggtagcttgattgggatggcattgaatctataaattaccttgggcagtatggccattttcatgatattgattcttcctatccatgaccatggaatgttcttccgtttgtttgtgtcctcttttattttgttgagcagtgttttgtagttctccttgaagaggtccttcacatcccttgtcagttggattcctaggtattttattctctttgaagcaattgtgaatgggagttcactctttatttggctctctgtttgtctgttattggtgtgtaagaatgcttgtgatttttgaacattgattttgtatcctgagactgctgaagtttcttatcagcttaaggagattttaggctgagacgatggggttttctaaatacacaatcatgtcatctgcaaacagggacagtttgacttcctcttttcctaactgaataccctttatttctttctccttcctgattgccctggccagaacttccaacactattttgactaggagtggtgagagagggcatccctgtcttgtgccagttttcaaaggggatgcttccagtttttgcccattcagtatgatattggctgtgggtttgtcataaatagctcttatattttgaaatatgtcccatcaatacctagtttattgagagtttttagcatgaagggttgttgaattttgtcaaaggccttttctgcatctattgagacaatcatgtggtttttgtctttggttctgtttatatgatggattacgtttattgattttcatatgttgaaccagactttcatcctagggatgaagccaacttgattgtgatggataacctttttgacgtgctgctggttttggtttgccagtattttattgaggatttttgcattaatgttcatcagggatattggtctaaaattgtctttttttgttgtgtctctgccagcctttgttatcaggatgatgctggcctcataaaatgagttagggaggattccctctttttctattgattggattagtttcagaaggaatggtaccagctcctctttgtacctctggtagaattcgactgtgaatccctctggtcctggactttttttggttggtaagctattaattattgcctcaatttcagagcctgttattggtctattcatggattcaacttcttcctggtttagtcttgggagggtgtatatgtccaggaatttatccatttcttctagattttgtagtttatttgcatagaggtgtttatagtatactctgatgtagattgtatttctatgggattggaggggatatcccctttatcattttttattgtgtctatttgattcttctctcttttcttctttattagtcttgctagtggtttatcgatgttcttgatctcttcaaaaaactagctcctagattcattgattttttgaagggtttttttgtgtctctatctccttcaattctgctctgatcttagttatttcttgccttctggaacttttgaatgtgtttgctcttgcttctctagttcttttagttgtgatattatggtgtcaattttacatctttcctgctttctcttgtgggcatttagtgctatacatttccctctacacactgctttaaatgtgtcccagagattctggtatgttgtgtctttgttctcattggtttcaaagaacatctttatttctgccttcctttctttatgtacccagtagtcattcaagagcaggttattcagtttccatgtagttgagaaattttgagtgagtttcttaatcctgagttctagtttgattgcactgtgatctcagagacagtttgttataatttctgttcttttacatttgatgaggagtgctttacttccaactatgtggtcaattttgaaataagtgaaatatggtgttgagaagaatgtatattctattggtttggggtggagagttctctagatgtctattaagtccacttggtgcagagctgagttcaattcctggatatccttcttaactttctgtctcgtcgatctgtgtaatgtggacagtgggatgttaaagtctcccattattattgagtgggagtctaagtctctttgtaggtctctaagagcttgctttatgaatctgtgtgctcctatattgggtgcatatatatttaggatagttagctcttcttgttgaattgatcccattctgtaatggccttctttgtctcttttgatctttgttggtttaaagtctgttttatcagagactgggattgtaacccttgcttttttttgttttccatttgctgggtagatcttcttccatccctttattttgagcttttatgtgtctctccacgtgagatggttcttctgaatacagcacactgacgggtcttgactgtttatccaatttaccattctgtgtcttttaattggagcaactatcccatttacatttaaggttaatatttgttatctgtgaatttgatcctgtcattatgatgttagctggttatgttgcttgttagttgatacagtttcttcctagccttgatggtctttacaatttgtcatgtttttgcagtggctggtaccagtctttcctttccatgtttagcgcttccttcaggagcttttgtaaggcaggcctggtggtgacaaaatctctcagcatttccaagatggccagataggaacagctccagtctgcagttcccagcgtgagcgaagcagaagatgggtgatttctgcatttccaagtgaggtaccaggttcatctcactggggcttgtcggacagtgggttcagcccacggagcagggcagggcatcgcctcacctgggaagtgcaaggggtctgggaattccctttcctagccaagggaagctgtgacagatggtgcctggaaaatcggtacattcccaccacttttccaacagtcttagaaaatggcacatcaggagattatatcctgcacatggcttggagggtcccacacccatggagcctcactcactgctagcacagcagtatgagatcgaactgcaaggtggcagtgaggctgggggaggggtgcccgccattgctgaggcttgagtagataaacaaagtggccaggaagttcgaactggatggagcccactgcagctcaagaatgcctgcctgcctctgtagactccacctctgggggcagggcatagctgaacaaaaggcaacagaaacttctgcagatgaaacgtctctgtctgacagctttaaagaaagtagtggttctccgagcatggagtttgagatctgagaatggacagactgcctcctcaagtgggtccctgacctctgagtagcctaactgggagacacctcccagtaggggccgactgacacctcatacagccaggtgcccccctgagatgaagcctccaggggaagaatcaggcagcaacatttgccgttctgcaagatttgctgctctgcagcctccgctggtgatacccaggcaaacagagtctggagtggacctccagcaaactccaacagacctgcagctgagggtcctgactgttagaaggaaaaataagaaacagaaaggacatccacaccaaaaccccatctgtacgtcaccatcatcaaagaccaaaggtaaataaaaccacaaagatggggagaaaccagagcagagaagctgaaattctaaaaatcagaatgcctcttctcctccaaaggaacgtagctcctcaccagcaacggaacaaagctggatggagaatgactttgttgagttgagagaagaagactttagatgactggtaataagaaacttctctgaactaaaggaggatgtacgaatccattgcaaagaagctaaaaaccttgaaaaaatattagacgaatggctaactagaataaacagtgtagagaagaccttaaatgaactcatggagctgaaaaccatggcacgagaactacgtgaagcatgcacaagctttagtagctgatttgatcaagtggaagaaggagtatcagtgattgaagatcaaatgaatgaaatgaagtgagaagagaagtttagagaaaaaagagtaaaaagaaacaaacaaagcctccaagaaatatgggactatgtgaaaagaccaaatctatgtctgattgatgtacctgaaagtaacggggagaatggaaccaagttggaaaacactcttcaggatattatccaggagaacttccccaacctagcaaggcaggccaacattcaaatacaggaagtacagagaactccacaaagatattcctcgagaagagcaactccaagacacataattgtcagattcaccaaagttgaaatgacggaaaaaatgttaagggcagccagagagaaaggtagggttacccacaaagggaaggccagcagactaacagtggatctctcagcagaaactgtacaagccagaagagagtgggagccaatattcaacattcttaaagacaagaattttcaacccagaatttcatatccagccaaactaagcttcataagtgaaggagaagtaaattcctttacagacaaaatataaatattttaatgacaatcccctcctcattggtacatagttagataatgattaaaacttaaaggattttcactgttgagtttgtaccactcaaggattttgcagtagaccagtaaatttaaaaacaaaaacaaaaacaaaaaacataattcatgttatgatactttagttcttagaaatgacaggttaaaaaatgtaccatattagaagctagacctaattgtacatagtcactaattagcttttctcttagctaagtcatgtatctttctagatattatttgtagtgcaaaatacccctgcaatgagtgtaatttatgcattggtaatgtatgattgcttctttcaagtctaatattttagaatccatgttgttaaacaatattaagttggaatatgggtgttacaaattcagatcagaaatatgtaatgtagtataatcatcccaaaatatgttgactctagaggctgtgcacaatggattttttaaaattacaaatggtaatattgaggtaaagtacataacttagtgtaaagaaacatggaaatttattgtttagtactatcaagagtatattaaaaggtctgcttaacttaatgaaaattatttttaatatcttaaatgcacccttagaaacaatagctattatctggcttttgaagtgatttggtaagatctttgttatcagagaaatattacatttcattttctccatataattatattcatttaataataattgactaacattgtttatgtacttggtgccatgcattgtgctagttctttaatgcattatctttcttaatcctgagagcaacactgtaaagtcaataattttatactcagttgcaccaatgagattgcaagactattaggatcagtataagaattctaagccaacatggatttgattcagaactgctatgtattgctacttctcaattaaaacaattctaagagaaatgaaacaattatcaatgaactgagccataagattccacgtcttatttttttaaaagagagatatcaaacatttttaaaaaatgttttattttcataagaaacattgcaattacaaatacaaaatcattttgcttcagtgagatcaaagaaggtttacatttgacagtatctgacactcaagtttcaaaagttattttcctgttattctgtgttttctgaatctctagtatctgagtagacagttgtgagagagatcaatagaatttttctctcaaggtgttattattttctaaaggagaaatagaaaataaataaaataaaaagacaggctgttatatgtgttctgcagtaattcttgaatttattcagaaatttccataataattttaatgaattaaataaatatactatcacgcattttggcaacattgagaatagcccccaaattttacatctttctctcaaaactggtttttttttctctcattttcttcatcagcggacttaatacaaactcagcaatttcttgtacagtatctgttttaactttcactgtgataatgagggaagtcattcaaacaaatcagctctgttgcctgggcaacacgtttctttcctgtgttcatccagttccagataggggtccattttaaccataagtaaagctatgtagattatatcccctaatgaatgatagagattttatcaaatgtgagtaatgaaaattgcctctaggagaaattgctctttatagagcaattgagtttagggttgagatgcaggattacatgaacataatctctccatacctattgaacattcattaggaaacattctctgagcacataagtaatgtgtgatgtatacagaaagatacagatccatgctctccaagaattcatggtaagagggggagatgagcaagaaaataaaaaggggaaagctgataatactttctcataagaaaatgataagtattctgttttcctattacaacgggccacagtggtatgagacagttaattctcatctctagcatgtggtctactcaccaaagccatgtctatatatactctgtggcagaaaaattcaaattctgaaagtgctgttgaatggaacagatcagacacagttttgtccatgaggcagcaaaattggctgaaattcaaaagtgccattcagtttcttccagcagctgtgttgtaagatcagactgaccaatttgaatagaagttttggctggaagttctcagaactattctgtgagagaacgtgtggaagcaaccccagagcaattgagacctgcctatgcgatggcaaacagcattttaatgatgcctctcccaataaactccatttggaaataacatttcttctgcctctaaactactcatattttattgcctgctatgcattcccttgagtctttgcagtgttcacatatatcatcttccctatgaaagagtagacacacatcatcacttatcgaaaattctcagacaggcttgcttgtgcataggcggtgtgccaatagatatttctagaaggaaataaatcatcatatatgtgtggaggtggcaaaatcttaacatctgaacaggaatttctcagtgaagtattctgtataggaatttctttcatatggctccagcaaaccaaattatattcttgtgaataattactgagtgataaaagcaaacccaaaaggaatgaaagtagtactgataaaattgacttaaaaagtatgtaggctatgtcataccacataccaattgctgtgagggggatgttttctggcatatgaataaattcatgtgagttgatttgaaaataaactattttgtcatcaaaattttgggaaaaataaatatgtactttattttcaatcacagcattagaaaaaaatcaaaattttctgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccaccttttgacggggttgtctgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcctttggtgttttagccatgaagtccttccccatgcctatgtcctgaatggtaatgcctaggttttcttctagggtttttatggtttaaggtctaatttgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagggataacattaggagatatacctaatgctaaatgacgagttaatgggtgcagcacaccagcatggcacatgtatacatatgtaactaacctgcacattatgcacatgtaccctaaaacctaaagtataataataataaaataaaaataaaaataaaaaatgaaaaaaatcaaaattttatattctctttatgtttatgtggaccagtaaaatagtcagaaaaccactttggactggatgatacaacagttttcacctacagggacacaagtgtttgaattttctatgtacttggaaaattggggtcaagaaaatacatttcgtgcactcatctactgtgttttattttctgctcctggtaatttccttggtgttctttgtgtaatgtaattggcttgacttgattcaatactaagcctatatctctaataacagtgttatttgggatctggcaaggccttttcaattgtccaccctagggttggacacttaaaataaaaataaaagggacctggcaaatagagaatagccaagtcaaaaaattgcaagtgagatgggcttaactccagtaccctgacaaagctgaggatactatagaatagtaacatgctagaagcaaggggaaactgtctcgcaactcagctacctggatgtctcaaagagacctcatttgacttcatttagtggcacgtccagtggcgttgaaggcaaaggcaaagaaatctgttttcctcttccaattctgagaatcaaaatgctgtagactgagtttgctttgcagggtgggttctcatcttgggctgaccaccagatggccacatgtgcaccagtcccggaagatcattctcctggggccctgtctcctagggcaggaaccactcctttaattacaatcgagtggaagtcacaagacaaaaacagaacaatcagctgagacttttagaagattacattcttcaggagattttgatgtttttatttttttataataaaagttaaaatatccatctgggaaaagttgtatgaggaagaacaagacattttaatattggatacctcagtttgaagtgtgaacaaggggcatagagaaatgtgtatataaatatatatatgtgtatatatactatatatatatactatatatattttatatatatagtctatatatatgtagtctctctatataatatatatatatagactatatatatatagactataggcatagatgaaaggttgagattagtttaagatatcctgacattttattataattgttatttcaagtgacaataataaggatcaattaggtttataacaaaggtgataaattatagcttaatttaaaaaataattttaaaagtattatcaatccagagaaactgttgaactctaggtactcatcgaatccaagctctctcctttcaaaaagattataggcagagacatatcttctgagactaaaatccaatcactttcaaactttctagaaagttttcagaaggagattatgaatttaattaaatttaatctcagctaactcttcacatggcatctgccacatggataacaaggatcaatgcaaaaaacttcttatgagtaatatgcagtttaattgcaaaactgaattagtgataactttcactagaataggcttatttatggtaaaatgtattaacaaatctatcaagatttattgtaaaatcaaggaatttttttacagaaagccagagagtgtctatctcactcaggagcatggctcaggtgggtcttccctcctgaaaaatgtctgattctttggtactgacagatggcttggacacctgtcattccaaggactgttttcaatgggtcagctgatttggctggctagattgatttgctccttctgtatctttccatgtaagcatctttaaaagccacaaaaggataggaacatttgtaaatgacctttttacatattgctgatctcttttcatgttttagttttaccttccctctcattaatcacttctagttccatgtgtttttatctctttgtttcacatgttgtcttttactcaacttcttttgaaatgtagaactatcttttcagtaagataatacattgctgaaggaaagaagtgtcccacttattttttcaataatcacatattaggttgttataagagtctggcatgagggaaataagtagactccataaatttatactgttaagagtagcaacagacttaggggatgaaagcaggttgcttcgaatctatcacatccttttgttataaattacttagacaaatttgctttagattttatctgaaggggtgtatactagacagtataattaaaggaacattttttctgggtctagaatatggtaattacaactttgttggcaattaagaaaaataaccatggatcgtgctatttgaatgttgaattagaaattaaaattcttaatgtctgagaattattttcataagaagaggaaagttgctaaaattttatgtcaacaattgcccaaaaagtgtaacttagtgaatgattttagagattactggatgcatttattccagaatgcatgccagaatagcatttggagaaccatcactaagaggtttgttacatcagagactagtcaacataccagatagtatcctgttaatatttaacagaagtagaaaacttatttattgagtttgggagaaaagcaattcaagggtaaatttataaaatatatatatatttataagtttattagtattgaaaattaatgaaacaaatgggctgacaaacaaatgaaacaaatgggctgacaccaaaagaagttgatttttaagccgatgattcaacttagtgtagacatattaattaataaaagtaaaacttcatcatgatatgactacatatttaaatattactcatttatgaatggttaatatactggtacacaccataatttgtttcatattgatgatgtaaaatctcatgtaggaaaagtgtaataaaaccaccttggcctatgatgaaagaagtattaatgaaggggagtcatttttttcaatcactgggaagacagcccaaagggataaagcactatatatatattatatgtcagaatcaatcttaaaaactctatttcctgacctttgcaataaaacccagtcacctatttgtactcttacttagcaccttcataatatgtgctgtcatgtaatgttcttaccttaagtctgtatactgaaaataggccaatagcagatttaatagaaaaaagtcgagtgggtgcacacaaggccaaatctatttacaatttaattacaggatctagaatcaacttatgatattaaaaacctattatattaaaggttccatggttccattacattctacaaaccactgttttctcatttagcagaatatactcttcataacaactcttcaaattatgaggctaagaaagcctaccatattttctagtaggccagagagtgatggagaagttattcaaaatctgttgttctgatctccagctctgtgctgtttccacaccactgagcaaaagcagagtctgtggatgtgaggatgaggaggaaagactgtagactgcattcattctgagccatgtaaaagaagaaggcatatcagctcagttcaaagactttcattcctggttcttaatgttgttaagttctgctctgtgaataaaatcaaatataacaaaaataccaagtcacctcagaccttgaaatgaaatttcatggcttcaaaaatactaagccattatttcagcacgagctaattccttgccatgacattagggcataaggctttttcataatagttaaaattttcactctcaatgtaaatgttatttttgaaaatgagactaatgttttatgttgcctaacactggcaatatacttaccaactatctctgaggaatgcactgagcatagggatggttgtagaaaattacacaattgaggcctgaatgcacgtttagcactgtgggttacgctttgcttccaacaactcctcaatcattgtaaaaatttaagaaaaaaaatttaaatgctcacaaagaaaagaattcattcacatatccactatatcagagttcagcatttatactcattgtgtggttgttatatatttaagtttatttagtattcataaatgcctgcattatatgttcttagagaaataaaaataactatttttcttaaaggcatacaaacttataaagtgcttaataatcagtattacattttttctatgtttttttttcagtatagtgaatggttttatttaaaaaataatgttatgtttaaagtaatactttctcatgataatatgttatggttattgaaatttttaaaatacaggaccacagatactaatataaagtattagtaatataaagtgcagctataatcagacatctaattccagcaatgtagaagactacttgcccaaatagcctttgtaatacattacaaattaaagaataaaaaactggatacaaatatcctctttatgtagagttgagttgacaacaaagtaagaggaatccagagaggcagaaacaatgaattggacaggcactgaagccacagagccaagggctcacagcctccttgatcctccatagcccaagtatctgcatttaaatgggcttcacgaggaaaagaagagaaagtctaggtcctgagaaggtgggaaatcagtatgggaatctcccacagaaacaatttccaaaaggtgattttctctaggaaagaactaactatgaagagaagaaagtaaccaaagaatgagacagtggggaaactttgatgttttggcttatatggaaggaggaaaacagctttaataaagcatttccaatgacaggctggttacaaggcatcttttagactagaatccactctacttctaatgccaaaagacctaagcccagcattaactttaagaagctcccactggtgacccttcctagttatctgacagaaagaaggcctaaatcaaaacctcaaaaatcccacagatcaaattttattgattgtgatatcacaattttcaaagtcacatgaaataagaagatataagccattgtgagcaaattttagaagaaacaataaacaccagtgtttttgtctgttctcatatcgctacagagaactacctgagactgggtaacttataatgaaaagaggtttaattggctcatggttccacaggttgtacaggaagcatggctggggaggcctcaggaaacttacaatcatatgggaagtcaaaggggaatcagacatgtgctatatagctggagcaggaggaagagagagaaacgggatgtgctacacagttttaaacaacaaaatctcatgagaactcactcactatcatgagaacagcaagcagaaaatctgtcgccatgatccaattacctcccaccactcatcctccaacattgggggttgcaatttggcatgagatttgggtggggacacaaatccaaaccacatcaaccaataacaaagtagcaaagattccagatggaataacagattttaaaaggcaaatgatagaaaagtagtgaacttttattagtctaagacgaaacagactttaagaccaaaagcttttcttgagatcaaacatgaaagtttaattcaccaggaggggagaacaatcctaaacttacctaaacatagtaacataactttaaaatatataaagtcaaaaatgaaagaactacaaggagaaattgacatatctggaattaactttaagaaggtcccattggtgacccttctcaggtgtatgacaaaaagaagggccaaatcaaagcctcaaaaaatcccacagataaaattttattgatcatgataccacaatcctcaacatcacatgaaatatgaagatagaagccatctttggggtaatttcaatgcagctgtctttaatgtcgataggaagtgtgtgaaagatttgaaccacacaaactgcaaggtgaaactgcaggttatatagatatatctgcactgaagcactgtctacttcctgaaaaatatattgttctgaaaaatatattcaaaagataacagggattatgagaacaaagagttgtggaagacagtacaaaactatgcagctttgtaacaagaggaccaaacagaaaggaatacatgagactggaggggataatctgtctgcccatccagatatattcatgtgagcacatgctgccacagtggttgctaaaaatgctccagaacaatagagtggaaatgtattgaagttttgttggagcagagctggtgggtacaaactggcagttgggaggagcatgagccagcgtgctcctttagggtgtctgtggaggcagggcaatggagcaagagtgcagcacagtaggaagagggttgtggccctgagaaggaccctggcacttgtttctagttttcttaagatacatgcagtagtgcttttcctgccagcatggcagcaacattgaagacttctatttcccaataaagatatgatcctaccatcattctctcccctcttgtctaaaatatttgtggatgaaccaacacagtgtttactccattctaaactaactcccttattaacaaatcacccatgagtgaattcaccttacagaaactcacactgtggctgcagatagaacactgcactaagcaggtggagaaaatgtcttcctttcaaatccagtccataaaaccagtactggtattacatatattatattatctgatgacagcacaattgagttaataattggtaacaaaagaaatcattaaaactcctatatatttggaaattaaaggaaatcttctaagtaactcatggtttaaagaggaaatcataatgggaagacatataaatgtacacaatatggtaatatagaaaatattaaatataaaaatttgtatgacagagagaaatgtatagcctttaatgtaatgtgggaaatgcaagacttaaaattagtttgaatgttaaggaatgtgcagtagagggaaaaaatagttacaatggggaattaaaatggaaaacaaaggcacaagggagggttcaacaaagctgaagtgttaaaaaatataagatcaacgtggcaaaatattaataaaaaatagaatattaataaaaaatagagatgataatgcaaggacttttacatctgctacccctcccaacacacacatacacacacacacacacacacacacacacacacacacacaagactgacagataataaaaccaaatacttaaaggcaatgagagagttagtaatataggatggatctggtagaagattgcagtatatccgtgtatgctgtatgtgtgacccatttaaaaaatatattttttattggacacataatagttgcatttatttatggagtacatagtcatgttttgatatgtacaatgtatagtgggcatatcagggaaattagcatatccatttaacaatgcaacaggttccttttgccagctgcccagatagagccaatttatcaagacaggggaattgcaatagagacagtgtttaatacatgtatagccagctaaatgggagaccagagttttattattacacaaatcagccttcccagaaattcagaagctagggtttttcaaagatagtttggtaggtagggtgctaggatatggatgtttctaattggtaggagatgcaatcttaggggtgcagaaaatggccttcatgcactgaggccacttctgggtgagggtcacaggagtggttgagtggagagttgcaggcaaaagcctgcaaaagccagaaaagacatatcaaaaggccagtcttgggttctagactagtaaattggagaagttgcaaaccttgtgacctctggaataatggctggtaatcatttaactacacctacaacttatagaaactcatcctcctaacctggtggtctttcattagatttataaaggcagtatagcctgagggaggggctactatcatttaaactataaactaaatttctcctagttagattggcccaagtccaggaatgaccaagggtagtttggaggttaaaggcacatctctttcactgtcataattttctgactattataattttttacaaagatggtttccccatcatgtcaaacatatcattttttggtgtgttgggaatcattgaattcttcttttctaactctctgaaaatatatgataaagtgttttcaactagagtcatcctccagtgctacagaatactagaacatatacctcctttttccttaattgtccagtttgggaggattttgaccactgacttcaaggcattgtggggacattagtttgccgctagggattgccaaggtagtgaccagccactggctaagagtaaggattcacttgatgcagacagaccctcagcggggattgcttctcagcctcacagcatctccagcaccaaaattaatttagaatggcccggggaactagtgaccacagttgcagacagaagcaaatgtagatgctctctagagacatataacaccatctgaggctttaatttatttctgtaaaaactcttttcaaatgcactcttcaacccacaataaaaataaatcactcataggagaaggggcaagaaaacatgcctgaaaatcagagaaagaatagtcaatagaaatagaccaacagaggcttcaggaattggagttattagaaagaccctgaaaaccttggtaccaataaatttgaaaatttatataaatttaaaattttccaggaccaactcaaaataaaacaagcaatctaagtattaaagaattcaaagatatatcaaggggagggtgatgaggaatgactgctaatgggtataggtttatttctggggtaacagaactgttctggaattagatatcgaggaaaagtacacaaccttgtaaatacattaaaaacaatgaattctacactaaaagaacaaaaatactggacttttctccacaagcagaatagcttagtatgctcattttatatggctagtacaactgatctcctaatagaaaaggaatataaaaatatgcaattttaatcaaatacacagatgcaaagtaattaaattaaaaattagcaacaggaatcaatgatatataaaaatatcataggaaataactagtattggaaataactatttatccttattgagtttattatgcaaaaggaaggtattttcaacattagaaaaatatgtccttaagaaatttaaggagaaatacgaccatctcattaaatgcaaaagataataatttgatgaaatgcatcacttaggaaacaaaaagaaaagagcaataaaatacagaaaatatattttttcaaaaggctgtctctacatcaatgggaactcttcaaatcaataaagtgcattttcaaaagagctacagcaaatttattgaatagagaagaataatttttttaaatccctgtaaattcaggaacatgacaaaaatgtttaatttcttttcagtgtagaacagatgcattagctacacaaaaatagtgataaccctaaagtataaggaatataagaaaggaataaaatactgtcactctttaaatgagacattcatctatgtagaaaatccagaagaatcccaaactgatagatttaataaaaaaatagtaaaattgccagatacaaatctattcaatttagtgagtgacacttttatacagcagcattatcaaaaaaacaaaaaatatttaaaatgcctaaatattatataatatgcataataatgaataatgtaagacatataagacctacatataaaaacatataaagtgaataatgtacattacagaaaacttaaataagttgggagacatatcacattagtggaaatattactatgctaaagatataaattctgcttacattgttttaaatatttaaaacaagggaaaagtgacatagattacacacacagatttttcaagcactatcatacttagacctaatcaggggacatccctccatgggtcccaggctttgtagatcccacagatcacaaacaaacagacatgcttttactaaagagcatatggctaatctgtcatgcaggatccagaactcagttttcaaaggaagactcaggaccctaggcctcaaggatgtgactaacaccattcacacctaagtaaacctttcttcatatctattctcctctatccgtaaaacaagatatgtttttcctgaatgcagttgtaaaccaaaagtaaaattctaagcaccccccaaccaactgactggactcctctcagctaagggcattttaaggtaaagctgaagttctagttcaggccaagatgggaatggatggttgaacatgccttgttatactttcctccctttggaatccaggcatagctgaccagcattaacattgaaacagagaccttaagactaacaaagcagactctgtagcaataaaatgccaacatgacagatagcaggcccaaaatatattgccctgatgtattttaaaatgttcctgcaaggctgtctcttctggggaaaatctacattctagagagaatccccttctcttttcaggctttttcctgataaaggaaagaattaactaaagagtctggtgtatttttttatttttatttttttttgagatggagtctcactctgttgcccaggctggagtgcagtggcgtgatctccactcactgcaagctctgcctcctgggttcacgccattcccctgcctcagcctcctgagtagctgggactacaggcgcccaccaccacgtccagctaattttttgtatttttttagtagagacggggtttcaccatgttagacaggatggtcttgatctcctgacctcgtgatccacccacctcagcctcccaaagtgcgtatttttaagtctgataagaaacattttaaatctgttctctctgaagcaggctacctggaggcatcatctgcataataagaaccttggtctccacaaccccttatcttaacccagacacttatttcggttggttccaggtctttagataaactataaatgctttcaaccattgtcagtcagaaaatgtttgaattcacctatgacctggaagtgccacacaccccaccaccttgagttgtcccctgccttttcagacagaaccaatgctcatcttacatgtattgattggtgttttttgtctccctaaaatgtatagaaccaagctattgcccaatcaccttgggcacatgttcacaggatctcctaactcatatttggctcagaataaatctcttcaaatattttacagagcttgagtcttttgccaacgccattaatatttcttcttttaactatattaaaaatagggaggattttgaatatttaagtgcttgagtaagagaaaagacaaattaagtaacacattagacacttgccaattcatgaatggaatacgtttttagataacaaagtattcttaatcagtagagccaaatatccattttgtttactttatgttgtagcttgtggttcaagaagtattgacaattggcatagtatttgcaacagttatcactggcagctgaaaatattttgcagtattaaaaatttacactattgttaattatgtacacatataggactagatatgcatacatacaacatgataccgattctttatattgacaacaaaatgaacacaatagaattgcaaatagtgttatttttattaaaaatactataaaagtttattttcaaaaagttaaattctggtttttatttttattgaagtaattttatgcaaatgttatatatattgaggactaagctctgatttttttatcttacccaaattcctatctaaggggtctggggagtcatcccctacaaaccataaattctcatcagatgggttttatttaaccctatatatcatgactcactttccaatctgactctggcataacactatgagacaaggaagaaaatcaaaatatttgatttttgcatttccctgatgtcctttgtgggggaaactctgtatctgtaaagaatctctattaagatagctagttttttttcttccaggccctcccagtcctaaagagattaactaaaagtctagaaacttttaaagatctgaataggaaacatttgccatctgttgtctctaagggcagccactataagacttcaaaagatccgtggtctccacaatcttttatcttaacctgaacatttcctttctatcaatcccaggtctttagacaaactcaaccaattgtcaaccagaaaacgtttaaatttacctataatctggaagcccccccacccactttgggttgtcacctttctgaaccaaatcaatgtgtttcttaagtgtatttggttgatgtctcatgcctctctgaaatatatgaaaccaagttgtaacccgaccaccctgggcacattgtagtcaggccctcctgagtgttgtgtcatggaccatggtcactcttatttggctcaaaataaatattttcaaatattttacagagtttgactcttttcatcaacagtatattcactataacacttcatttaatttgaatagatggttctgaatatttaccaaaaaaattttaaaaacagatttgaggggaaagtttgatttcagcactaatgggtaaagaatttggatgttgttactctagtttttacaacaaaatacatctggacacactgaaaatcaatgattttttttgtacttaccaataaccgaagctgccagttttatcatcaatataaaactctggggagacaggccaatttggagatcgacagtcaagattgcttctgtggagaagaaggccctgaactacagacctatagaaaaaatgaattgttgatgttctcaaattggtgaaggcaaagtgtagaatagcataagaatgagaaactcatggtgctgcagttttagagggggtttcacttccaggaactgaccagattctgatggtaaaatccaagaaagagaagagggaggggaagagtaatcattgtgaaacaggtcttgagaaatcttcattagaaaacctactctacaaggcaaaagaccactacagttttgtatcaaatgcagaatggtatttctctcactctagttccctttagctttcctgcatcacctaagagaatatctctggagaaaaacttgtgaaggtcccagaccacacacagaggcccatttggaagaaaaaaatttcatcatcaggttgtagaatgattctcctctctgacccttcccactgcatcaacgcagctccagtaaaatatcagtagctagagttgaaagagctataagacacagattttccctgaagacaagtcatcggagaagccaaaagtcaagggaacaaggataagaaaaaaaaaaggaaactatgagagcctttgacaaccataactgagaaagtatttataaagcccaattcctagccaaattaacatatatcccaaaaggtaaggtctatttcatctttagtttatactcaatgcaatacgtccagcctccaaaaaaaatgacataaacaacaaccaaaaaaaaaaaaaagaaacaccaacaccattataagcaaaacacagtctgaagagacaaatcaaaaattaaaataagaatcagattatgacacagattttgatattatcaaatggagaatttaaaaatagttatgtttaatatggaacataacagaaaaatatagacagaaggttaatgaaagaagagtgatagaaactctaaaaatgaattaaaagaaaatgtaagaatcaagaacattgtaagagaaatgaagaatatctttgctgttctaataagtagacttgacatagccaaggaaaaaaatattacgaaactaaaatataaaaagcaaaaggaataaaagaaacaaaacatctaagaaatgtgagaccatttcaaaactattacatacaggtatgtggactaccttacaaagaaaaaaagatgatcagaaggaatatttgaaattatgatagctaagaactttcccaaattagtgacagataccaaaccacagatccaaaatgaacaatcaatgccaaacaaaatactaaaattacctatctattcctaggaatatttaaattgttgaaaacaatggtgaagagaaaatcttgaaataaaccagaggaaaaaacttcttaaatatggaagaacaagaataaaaattacaagagacttctcatcaaaaaccaacccagccagaaaagagtggagtgaaatgtttaaaatattaaaggaaaaaaattacactgacttaccgttctctatgttctgcaaaactatcctttgaacatgtagaataaataaagaccttcttagacaaaaactgagggaattcatcactagaaaatatgacttgtgagaaatgttaaaagttcttcagggagaaggaaaagaatataactcacaaatgcatacctgtagaaagaaagggagagcacaggagggggaatacattaagatatatttaatgtgttatttgtttaattcttggctgaaaatatagctgtttaaaataataatagtaacaattataaagtgattatatcatatagataagttaaatgaatgatttcaatgtcataagaggtgagagagtaattgggagtactctgttgcaaggtccctatacaagtaaagtggtttattgttatttgattgtggatttagatcagctaaaatgatatattatgaactctagggcaattactatttctaaaaatgtatggtggatatgcttggaaaggagataaaatgctcaattaaaacccactaagacagaaaaagaggggaaaataaacaaaagcaaatgcaacacattgaaaatgcttaagtatggtaaatattaattcaataattatttcaagtggacataatcttaaacataccaattaaaagacagtgagcttcagagtatacccaagtgtatgctgatacactatcagaaatccactttaaatataaagaattaaatagtttaactaaaaggatagagaaagatatactttactaacacaaattaaaaaaataaaaataaaaagactgggttagctatataaatttcaaggaaaaaaacccagacttccaaacaaggaagattatcaggaataatgatccgttttacaaagcaatttaacaatccttaacatgtacacaattaaaaagagagtcaaaatttgtgaggcaaaacttgatagttgttaaagataaaaatatgcaaatgtaagagtgtagtttgagactttatcacccttttttttaagtaacattgattaagcaggcaaaaatttcatttagttgactgaatagcactgtaaatcagttagttctaatggctttttatagaattatccatccagtggcaagagaattcaaattctcctccagcttatgtcgaacattcatgaagaaaaattacgttttgggcaacaaatacacattaacatatttaaaataacagaaatcatgcaaagtctattctcagacttcaatagagttatgccaaaactcaataacacagtgagatgtgggacatcctccaatatttgacgattaaacaacacacttctaaataacacataagccaaagtagatgactcaagactaacttaaaaatattttgacttaaatgaaaatgacaatgcaacttatcaaaatgtgagatgtggcaaatgcaatgtctagagggtgatttacagcattaacaacaaaattagagaagaagatctgaaacaataatgtcagcttccaacttaaaaactagagaaaaagcaattttagcctaaagcaacagaagaaaagtaaagcagaaatcaatgaaactgaaaacagaaaataatagaggaaatcaatgaaacaaaaatctgtttcttggaaaagattaatgaaactgacaaatctctaaaaagattgagaaagaaaacagagaagacataaattaccaatattactatgaaagaagggacgtcactacagaccctggaaaaaccaaaagtacattaagggagtaatactatatgtatagctttacacataaatgaacaagttagataatatggatcaattacattaaaaggacaaactacctcaacttgtccaatatcaaatacataatttcggagctttattactattaaggaaatagaaagtataacataaaaacttctcaaaaaagcaatctataggacaagatcgtttcatttgcaaattctacccaacatttaagagcaaaaatacaatgggaaaatgacagtctctttaataaacgttgtagagaaaacaggatatccacatgcaaaaaatcagcctggacccttatctcagaccatgtatacaatccaactcaaaagtattagagactcaaacataagactggacactgtaaaactactagaagaaaatagggggaaaactatctaacattggtttgggtaacttttttttttttaatttgactcaaaaaccacagtcaacaaaagcaaaaatagataagtaatgttacatcacagtaaaaagcttctgcacatcaaaggaaacaagagtgaacagtcaaccttcagactgagagaaaatatttgcaagccatacatctgataagggattaacatccaaaatacataaggaactcaactaactctaaagaaataaaacaaataatctgattaagaaatgggcaaggaaactgaatttctccaaagatacaaatagctaacagatacatcaaaaaaattcaacatcactaaccactggggagatgcaaactaaaaccactatgagatatggccttatttgtattagaatggttgttattaaagaaaagacaaaagacaagcattggcacagatatgagaaaagggaaccctcatacactaatggtgggaatgtaaattagtacaactattatggaaaccaatatggtggttcctcaaaaaactaaaaagagagttaccatatgatccagcaatcccacttctgggtatttatcaaaaagatttgaaatcaatatgtcaaatagatgtctgaactcatatgttcattccagcactgttcaaaataaccaagtgattgaataaacctaagtgtctatgaagggatgaatgaataaagaaaatgtaatatatatggaaaatgcaacactatttagccttaaaaatgaagttctgttgtttgtgacaatatagatggagaatattatgctaaattaaataagccagaaacaagaaagactgattccaaatgttctcacttatatatgaaatctaaaaagaaacgtttagaatagaatagaaaggtggttacaaaggctggggactggggagaatgggaagatgataatcaaagggtacaaagcctcagttagaaggaatacatttgctttattttttaaatcagtagcacaatatgctgaatattgttaataactgagtactgtacatttcagttttgctgagagtaaatttctcatggtctcaccatcaaaatagttgcatatttgaagtgataaatatgttatttagcttaatttagtcattttacattatattgaactgtcatgccactttgtactccataaatatattcaactataatttatcaaaatattaaaaaatgaaatgaacaccaattctatgcaacgtcttcctgaaaatgaaagaagataaaacacttaccaattcattttaatgaagctagcactactgttcccaaattagcaaaggcagaatcaaaacaagaaaaggcaaaaataaataaactacagagcaatatgtcttaaaaatatagatgtaaaactgtttttaaaaattttgtaaagtagaattaagcaacatatataggaaatatacactgtgaccaaggggtcttattccaggcaagcaggctgtttcaacattttaaaagcaattagtaaaatccattattttatcaggctaaaaggaaaaatcacctgaataataatttgacaattcagcacacatttatgattaataaatactctcagaaaattaatagtaggaaagaacattctgaacttaataaagaggatctataaagaaaaatagaaaaactacagctaacttcatacataatggtgaaagagtgaatctttacccttgagtttagacacaaggcaagatgtttactcttttcaatttttgtgaacatagtcctgacatttttaaacagtgcgagatgacttggaaacatatgcaaaagagtctgaaggaagaaataatattgtccctatttgtagatcacatgatcacctacatagaaaatcttaaggaatataaaaactaacttcctagaactaataagtaagttcagcaaaaaccacaaaaatacagatcaacattcaaaaattgctttgtatttctatatactagcaatacattgaaactaaaaataaaattccaatattacttacaattgctcaaaaaatgataaaatgctgtgatataaacttaaaacacctacaggactttaacccgaaaactcaatgattctggtgaaataaataaaaatgtaaataaagtcatactgtgttcatggattataacactcaaaatagtgaagatgtcattgtcaaattgatacataagtttaatgaaattcctgccaaaatttcaacttgatatgttgtggatatagacgttattgttgtaaaatttatagaatcaagccaaaaaaatgtaatagcaaaaacaattttgaaaagaaagaataaagcaggatggatcattatacctgattttcaagataacagtacacagttatcaaactgtgtggtatcagcagagggatagatacatagatcaatggaccggaagagatggccctaaaatagtcacatacaaaaatgaccaagtgatttttggcaaatattcaaaagcaattaaatggaggaaggatagtcttttcaaaaaatggtgctggtaacaattggatatcaacaggtaaaagtaaaccttgatttaaacttcactcctcatgtaaaagaaaaaaataaagaaaacttcaaaatggaacataaatttaatttcagcctttaactctataaaactttgagaataaaatataggagaaaatactaggacctagagtttggttaagacttcttagacatgaacaccagaagcatggtccatccaaaaacatcaatcaaaaatcaattaaacactagctttgaaaattctgttaagaagatgaaagacaagccacaagctggcaaaaaatagcttcaaaccacaaacctgataaagagcccatatctagaatttataaagaattctcaaaacttcactttaaaaaaacccactaattagaaaatggaaaaaaaaatgaagacacatttcactaaagaggctatatggatggcaaataagcacctgatagaatgttaaacatcattaaactttaaggaaatgaaaatcatcctagcaatgtaatgtcctacaatgttaggagagctaaagtaaaagttactgataactccaaatgctggtaaagagaaagagaaaacggatcgctcatatatttttgtaaggaatataaagtcataaagccactctgaaaaaaatgctttggcattttttaaaaatcaaaccaaacagaaattgaccatgttaaccagtggttgtattcctgggcatttattctagagacataaaaattcatgcttacacaagatccatacacaattattcataccaaattcatttgtaatagccaaagactggaaataatcaaatgtttctaaatagttgaatgattaagcaaacttttgtacctccatatcatgatatactttcatcagtaaaaaggaatgaactaatgatatataccaaagcttgaactgatatgaagaacattacactgaaggaaaaaggctgtgtcaaaaattgcatactgagtgatgccactgaatgacaaaaggattaaaatggcaagcagattagtggattgcgtgggttaggggtgtgtgtgtaactataaaggagtagtacgagggagttgtggtcatggaatagtttttcaaaatagttctgtaccttcatttggtgttggtaaccagaatctaaacatgcaataaaatggcatcacactatacacacactttgtaccaatgtcaattttctgcaatgatattttaccatacttacatcaagtgtaaccaatggaaaaaactgggtgaagggtacaagcagcctctctaggctgtctttaaaactccctgtgaatgtataaaaagtcaaaataacaaattaaaatgtgttacatctataaaaccatatcctaaatattgctactattagtatttctaaatattataaaaacccaacaagataaatttatatcacaaagtgactaaaaatggcatcaagcaatcacttcaacttttaaaaatggtcctttggatctctttttctgatagatcatatcagaatctttttgctagaataagaaaaggaggacaacagctaacagatagaagctgttgttagtagatgtggaaaaattgataagattggcagaaatagtcataggatattagacaaaatcagtgtgaggaaagatgcaggtgcatttggaaatttcagtgaaaagttaaaactgaaagaatcaaggttagcttggttagttgacaaaaatttaagaaatgctgacaaaatgtatactgttctctactggacatatatcaaaaggagttgaaatcagcatgctgaacagatatcagcactctcatgttcattgcagctgtatcataatagccaagacatggaagtaacatacgtgaccaccaacaaatgaatggataaagaaaatgtggaatatgtgtatagtggaatactactctgtcataaaaggaagggaattctggcacttgtgacaacagggatgaatgtggagggcattatgttaagtgaaatgagccaggcacagaaagacaaacatagcaagatttcactcttgtgggaccccaaaaccttgttctcataaatagaattaatcattctgtatatatcctgcaaaacatcatgttgtacatgacaaatacatacaattttatctgtcaatttaaaataaaaacaaaaattatgacataaaaacaacaggttttctaagaaaaaaatgtacagtgatctgtgagtgagtggaaatcaatcaacacatttttgttggaaaaaataaatatcaaggtcaactatgcttattattggaataaacttgctggtttatggggaatgtgttggctagtggattacgtgtgaaggaaaaagctcattagataagaagtaagtcaaagatttgaaaaacaattatgattctcttctttttactttgtaggtgttctttccctaaatgcatgggaagacaatggtataaaagtattcaaaataaatgtacttcggttttcttattttcctccaagtaaaatatgttagcagtttctcacaaaaacttcagccaaaaaaaaagaaaaaagaaaaaaatgtttctagcattatttaaatttaaagtagataatattctacccataaagaaattcccatagttaaataatctcttcttagtgagtttataaaccaacctaagatactaaagcccagtcatctaaaagagccgtgtagttgtctctgtcccacagtgtgagagatttttgaatggcattgggagtatggaggagaggttgtgccactttaagatggtacaattttatctggatggtttttccacattacacaaatttccttttcctagtctaacaaagagtgccactatagattattataatatgctatatcttgctcaggtgtactgaatacaaaagtaacacattaagaagataaaattttttgaatagaaaatagactataactgaacgtagacagacattccataatatttatttctaattagtgtcttagtgactaagttcttaaaccttctccttccaaggtatgattccggtgcatcatttttatacatttaaattttacaggtgataaaaagctctgaatgtttacagaaactttttaattgtaaattttttttttttttttttgagacgcagtctcgctctttaggccaggctggagtgcagtggcgctatcccggctcactgcaagctccacctcctgggttcacaccattctcctgcctcagcctcccgagtagctgggactacaggcgcccgccactgcgcccggctaattttttgtgtttttagtagagacggggtttcaccgtgttagccaggatggtctcgatctcctgaccttgtgatccgcccgccttggcctccaaaagtgctgggattacaggtgtgagccaccgcgcccggccaaaaatttttaaaacatatatttatatatacagatataaaataacctaatgaactgaaatgtagacattacacagcttcaagaaatgtcaacatgttgtcagttttgtttcttcctcctgtactttctctgggttatttggaagcaaatcctagatatcataaaaacttcctttaagtagttcagtgtgtgtatctaaaaaataactttttgatttacagcaataccactatcacaaatattgcttgaatacaaacaagtacttagtatttgaatttccccaattgttacagaatatcttgtaataatttattaaaatcagaaatctagtaaagattataaattaagaatcacacattaaatctttttttcctcactctatttttttacctttttttttcttgcagttcatttcttgaaagaaccagaaactttgtctgatagtgtttctcacagtcaggatttgtttgcaattgcttttctatggagtaggttaacatgatgctctactctctactgtctatatatttcctgcttatttgtaattggagctctaaggttgataaaattcgggttccattatttttggcaagaatactttattggtgatgtcatgtacatctatcagatgccgtgtgttaactttctctcttttcatgaatttggccatcattgctgatcattcattagatttcttatttcattggcattttgagatgacattcacttattccctagaatatatttaatggaaaacatcatcttatcaactattcatgtaacttgaaaaacagaccttatagaaaagacaggaaaaatgctcaattatttatctctactttcaatataatgatttttttcctgaactctccttcaaagaaggcaaaaggggattttattttagtatccatttaaattcatagttttaaacatatttaatccatcactgttaagattctcactgatgctaaaataatctcaaatttggccaataagaacttcttcatattgtctcctgagtctatataatatatcctaatagtgtaaggtagtgttttgtcttcttttataagagattttaagggttatacattacttgtcctgaaattacctatttctataaaaaaagatatttagatatgaaactctgggcactctggctactcattactactcaaacagtcttcgtttctttgcctattactagaatgatacaactttttgtttttaagataagacacatcatgagatcatatcctgattaaaattgttgagccatatgcataggaggaatcaatattattaaaatggccctactgcccaaagcagtttctagattcaatgctattcctatcacactaccaatgacatttttcacagaattagaaaaatttctaaaattcatatgaaactcaaaatgaacccaaataaccaaagcaaccctaagcaaaaggaacaaaactggagggatcacactacttgacttataactatactacaaggctattgtaagcaaaataacatggtactgatacaaaagtagatacataggctaacggaacagattaaagaacccagagattaagtcacacagcaacagccatctcatctttgtcaaagctgacaataaaaagaaatgggaaaataattcactattcaataaacgatgttgggatgacttgctagtcatatgcatgagattaaaactggaccccttccttacaccatatacaaaaatcaacttaagatggattaaagacttaaatgtaaaacctaatactataaaaatcctagaggaagacctaggatatatcattctggacattatttctggcaaagatatcatgacaaagactcaaaaagcaaccgcaacataaacaaacattgacaagtgggacctaattaagctaaagagctttgcacagctaatgaaactgtcaacagagtaaacagacaacctacagaacggaaaaaacatatttgcaaagtatgcttctgacaaaagtctgatatccaaaatgtacaaggaactcaaacaaatttgcaagaagaaaacaaacaaccccattaaaagatgagcaatgttcatagacagacacttcccaaaagaagaaatacacatgaacaacaagcatataaaaaatgctcaacattattaatcattagaaaaatgcaaatcaaaaccacaatgagataccatctcacaccagtgagaatggcgattattaaaaagtcaaaaaataacagatgctggagaagttgtgagaaaggggaacgctatacacagcttgtaggaatgtaaattagttcagtcacacgaaaaccagcttggagatttctcaaggagcttaaaacaaaactgccattcaaccctgcaatcacattactgagtacataagcaaaggaatgtaaattgttctaccataaaaacatttgcacatctatgttcatcacagcactattcagaatagcaaagacagggaatcaacctagatgcccatcagtggaagactggatgatttagttcattcgcacactgctataaagatagtacccaagactgggtaatttataaacaaaggagttttaattgtctcacagttctgcatggctggagaagtctcaggaaacttacaatcatggtggaaggggaagcaggcaccttgttcacaaagtggcaggagagaaagtgagtgcaaacgctggaaaaactaccatttataaaaccatcaactcttgtgagaattcatttactgtccatgagaacagcatggggaaactgcccccataatccaattactcagttgtaaatgaggaccagttggcaatggaatttctcctaatatcaagggtatcagaataatatctgatttccctgctccactttctcctggaatcactgctgacttcaccagggattgttgcagtgtgtggttcaggcttccaaatcttttaggtttgtgaggatacttcgtcaatattgttacagatgttcttcatagttttgtttgttcctttaattattcactaggtttacactgcttatgctattgtttcatttatttcagggatcaggggagagttaaagattttggggtgggtaaatctactattatctttccagacctcggtctcaatttgatagtatgctcaacagttagaacagcatcaatttaaaaatcccaattctcctttctgatataagaacaacctttgacttccatcacttctgaaaattcactaagtaactataatcttttgactgctgcaatgggcaggaagttgtaggtatatttgtaaaaacagttaatgctaaagatattggggttaatggaaagacaaactaaagactctcttggtatttgcagagagagctcattaatatgcctgttagacttttgcaatgagacatgcctagatatttccatttgaagaaagtaaattaacagaaaaggaaataagccatttttgctcctgaaatgcaggcaaggctttgcgtattgtttgctttcacaaggattccaagcacttttcttttatgaagttggttttgtatttttaatttcagcagaaggtgacaacaggctgaattgcttttctcaataccagaattcataatttctccttaataatgattgtggaataaatgacatttacttagctaaaaaatttaaaattccagtaagtctctttagttacatttgaaataatttaaattttacgaaccatcatgaatcctgaactctacttttgctttgtgacttcttagaacaaactaaacctatcacaagattttatatattatgtaaaaaacaattttgtaccaagagagctctcctctacgattagcaggagaggcgggaaacaagcggcacagaggatcctggagctcagtcaagctccatcctccccgacattgtctcagcccatagttaagcaacacttcggttcttcatgttggcctctgactcattccctcacccataagtactttatagcataatgcttaaacaaagaaaataagtttatataaactaatgcttaaacaaagaaaacaaatttatgcttaaataattttgatttaccagtttctaaaatagaggtatttcccgtgaaagattcatattccaatttcatattttttaatctcaaggtgatgatttatatttttctggattttttttccctaacaacgaagggtgataaatagaagaaaggtagccttaatgtaattaaaccttgataaattcaaacaatgtccactataaaaagtctttagggagtttatgaggtcataggatagtcttctctttccttaggaagttagagtaagtagaaagacaatttcctctcagtctgggttaaggctagtggtagagtaaaaagttctgatacacttatacttccagagttaatgtatacatttgttttgtgtttttaattttacaaagtgttttgaaatattgtggttctttaaaaatgtttttactctctagctactgatttatgtgaacctacattatatttaaagtcaaatatatagaaagaagagcagagagtgtgaatggcaatggcttgccatcagagagatactttgagaaagacaagttcagactgaatgttactagatgaggtgacagaatggttccaggtaaatggaagaaaaacaatattttttaatgtgtggcaatattctgttgaattttagtctctaggctgccacagtgacaaagatgaagctatgcaatatttctatgaatctgtttaggggctggagtaaagagcagttatttaggtgggtggtgtctgatgtcccagtgggcagacattctgcatctatgaagcttcttcaaggccttaagtactgcttttaggtttacgtgaacagactttacttttggcgaagagaagagtaaggtgatgtctcaatgtgaagaggaagttgcaaaaacagttttcatagtgtgccaacatgaactaaggtagaactatattgatgagcagggttaatgattcatgccagatgggatgataatgaactttacaattatgcagtaattcctcttctcagctcggaagtgcctcagagtacgcaggtagaacttgggaagcaatagggatcccactgcccagcactaacatatcagtctcaggtcatctgcccatggtcttgaggttctcactgcaaacactaaacctcacttctggagtgatgggggatttaggctgatacttgcttcaaaatgctccctcttaactggagccctccttcctctcgatggatcactagatagatacatagatagatagacacacagatacacacacacatatctacgtatatatacgtatacatatctacatatatatgtatacatatatacatacatatacatatgtgtatatatgtatattaatatttatatttggtttatcataaagaaaatgtcttctataagtctttgaataaagctgatgctctaagaagatgtatcctaggccaggtgtggtggcttacacctgtaatcccaggactttgggaggcagaggtgagtgaatcgcttgaagtcaggagttcaagatcagcctggtcaacatggcgaaaccccatctctactaacatagaaaaattagctgggcatggtggtgtgtgcctgtaatcccagctacttaggaggctgaagcaggagaatcacttgaacctggcaggtggaggttgcagtgagccaaaatcatgccactgctctccagcctgggtgaaagagtgagaatccatctcaaaaaaaaaaaaaaaaaacacaccaggaaatgtattgtatttattctgtaggtttttatggaagcttgtatattgatgtgaagcccccaaatatgtacacattccaacttgtgaggtgtgggagtggttagtcattatctactctgtatctttccattaatttgtttgtatagccatatccatatcacgtatgtattatgatattattactataataattactatataattatctattatcatatattatctatttatattaccatattatctatttaaagaaaatataagcatgtaaataaacatagaaaatataagcacatatactaccttttatttatttatgtgcttatagaaaataaataatgtatgtttttagaatagcattgcatagaaatcatgaaattttctttgattcatgcaggacttacagagcatgtctgttgagatctatgagtttgtctgttatttctactaaggttttgaaatagttttttgaatattgacacaaaataaataaatttgacttctgagagttaattacatgtgagaattagtaaactgttgaacaaaaaacatgtatctatgaaatatttaagaataaattgaccgctaatggtatatgttcagataaatgagtcctgaattatcttatatatttgaaagacctctgtgaaaattaattatattgtaacattttaacagtctgacccaaaactatgtgacagtattatctgacatttcaggttcataaaagaattgcaattatatatgcttagttagggtttgatgcaagtgtaggttttctgaatttatagatatttttgaataattcaattatggagtaacttttccctattttactaaaatttatctagatcaatttgatttttaaagatcctctcatctttctttccatctctactgtatccatcttagaaataaaaactctccggatttgaagggattttaaaatgcaaatgtctgtttgctgcatcaagcaattctactctattcctggataccactgattaaccatttttaaacatcttcagggacacagaactcactagttttaacacaacactttttgggcctactgtaagagcaaatgtgatgcattttaaggcgtttgggccaggtctcagggtaattaattaattttttttttactgttccatggacatacacacagattacatgttctagaatgttagattagagtttaaaactctaataagtttcctcttttcattttatgaaaaaaacaaatacatgattcaagaatgaacatatgattgaggataggaataactgatatattccctaatatctcctttttcttcattgagataaccttagaagactgaggaatcgacctttctgtcattgagctggggttttgggggaaggagaatatattagaccattcttgcattgctgtaaagaaatacctgagactgggtgatttataaagaaaagaggtttaattggctcctggttcttcaggctatatgagcatgttgctggcatctgcttggcttctggggaggactcagggagcttttactcatagcagaaagtgaagtgggagcagacatgcaggagcaagagacaagagagtagtgggaaggggagtaccataatttacaacacgcagatcttgggagtacccactcgctatcatgaggacagcaccaagccatgagaaatccactcccgtgacccaaatacctcccaccaggtcccactgccaacaatggggattacaattcaacatgagatttaagaggtgacaaatatccaaatcatgtctgagaaggcttttagtaagtggggagattctttttttcactgtgtcaacaggctcaaagtatcaagggaggcctacaaaatccaaccttagatcctcttgttattcatatttgtgtttcatgacactctaaaatacaagtcatgagcttcaaaaccatatccatctgattccaaaagtctgtgaatgtcctacctcaagcatatatatttttaaattctaggttgagcatgtttaattttctgtttccctcaggaggactctggttactttaaatttcaatataaaatttagctgttctgaacatagggagctctattagcacagcagacattctcatgggctccaacctgaatatctaccgcatccacaaatatatgaatatttaccaactctttgccaatgtaagaccacataatggttagtcaagtgtcaagatattcaggttaagaaaaacttgcagtctcaaatatgcttggcgatcacagaatagatgctagatacttatttcaagtgtattatcctataaacctaattcaaagagagaaaaggatagatagacattctacaaagctaggattaattttcatttgaaaaattttattgtacagtttaaagtatgattcatgttaatataagtaaatgccatttttacattttttttccattatcattcttgcaacaaaagttttattatgttttcttggttggatcagagcaattacaactctcaaagtgtctaggaatcatctcagtgcatgtgtacgcagcaataaacatgcttcattctctgggtcagtcagattgttctctctcttccaaatggcctaagaagttaacagactaaatgaaggtgacttgaaaatcatgcttggggcttctctcacactcctgaaagcacactgatctggagttttcagtgtctcacaattccttgatttgagacagatcaccagactatagattctttggtttcttctgcttttttaagtttgatagttaaataagtagcagcatggtatggagggaggagcagaaactgtaaagtgaatgtaaaatagcctgagtgtggtggctcacacctgtaatctcagcactttggaaggctgaggcgtgcggatcacctgagatcaaaagatcgagaccatcctggccgacatgatgaaaccccatctctactaaaaatacaaaaattagctgggcatggtggtgcatgcctgtaatctcagctacttgggaggctgaggcaggagaatcccttgaacccaggaggcggaggttgccatgagccgagattgcaccactgcacttcagcctaagtggcagagtaagagtccatctcaaacaaacaaacagacaaaagaaaacaaaacaaaaaaaggatgtaaaatagatgtaaagtcctcttctcattgtgacctggggcttgtcagccatccctgtgagctcaactttcttatatgtcagtcgtaacactatagtgatgagaatattcttgtcttgtggtagtcattatgcgtgatagaacgtgtaagtacaactttgcaaactatgaaaactttgtcgattattaagaattacatcaatgcctatcccttttgtcctcaaattagggtaaccgctaaacaattataatttcaaaagccatggtcaatataatagccagatgaaggctttatctattttgtaattaaagaaaaacagtggaaaacattaaataatccttattaaaatgtattaaaatctctcatgcacagaagtaatacagacctgatactagatgcataaaatgtgaaactattaataatgggtaagtagatattgtctgatcatttaaaactggagtagaaatataacatccttaatctgcttattctttggtaagttcctagggctatggtaacaatgatccacaaactagatagcttaaggagcagatacaaggggacatcaaaaagtgtgtggaaaaatggaattaaaagacaacaataaaaatatcaatcagctctacttctcaacataagttccatcaagtttaacacacttttgtaaatgatgataccagccatttagtttatccataaagacctgaggatcctgggaatagaaccaagtcaatccactcttcttaacattactaagtgaagaaacattagtgtctttctttttttttttttttgcttaattagaaaagaaagaaagtcagaaggagccaaatcagggtcgtaaggtggatgcctaatgatttccctcgaaattgctcacaaaattgcccttgtttgatgagaggaatgaataggagcattatcgtggtgaagaagggctctttggtgaagctttcttgggtatttttcttctaaagctttgggtaactttctcaaatcactctcatggtaggaagatatcatgatttgaccctccagagagtcaacaaataaaatgccttgagcaccccaaaagaccaatgtcatcctcttgactggtccactttggcattgactaaactacttcaacctctttttagccattgcttcaattgtgctttgtcttctggattgaaacactgaagccactgttacaattctttaagcaaatgcttcaggatcttgaactcacttgttaaagatttccattgaaagttcggctcttgtctgtagctgatctggacacaaagggcttgtcacccactgaatggaaagtttgcttacctttaatttttccatcaggatttagtaagctgaacctattaaggtgttggctattgtttctgatcttagtcattggtccttttccattagggaacgaacaagatgaatattttctgcacgatttgtgtatggtctattactgcaggcttcatcatgaacattgtctcatcccttcttataatgagttatccactcacaaactgcttatttctttggggcattgtccccataaactgttcataaagcatcagtgatgttaccattcttccacccaagtttcaccataaatttggtgtttgttcttgcttcagatttagcagaattcatattgctttgataggggccattttcaagctgaagaaagcatcatccttcttagtgcctcaaactagattttgttctgtcatgttatcttaagttagtgcaacttactttggtgcaaaaaaattgaaatctatgaatagattaaaaaaattttagagacaaatactctgtcacccaggctgcagtatagtggcatgatcatagtttaatgtaacctcaaactcctgggttctggtagtcctcctgcctcagcctcctgagtagccaggactaacggtgcattccaccagtcccagctaaagtttttagtttttttttttaatttttattttgtagagactgggtcttgtcacgttgcccagactggtcttgaagtcctgggcttaagtgatcctcccacctcagcttcccaaagtgttggaattacagccgtgagccactgtgcttggtcccatgggtttttcataatactaattttccatgagctttttgaagaccctttgtatttattgtctcataattttgtaggcaagaagtctgagatcaagttgttggcagggttggtttcttctgagagctatgaaggaaagatcagttctgggactctttccttggcttatatatggttatggtcgtcttctccctgtgtctcttcacatcttcttccctccatttgtgtctttctctgtacccaaatttcccctatttataaagacatctgtcatattgaattagggtccacacatatggcttcattttaagttgattagttctgcaaacaccttatctccatataagctcagattctaaggaacgaggagttaggacttcaacatttgcataatggtgggggagggaaattgtcaacccataaaatagtctatgtttaaaagcatagcccccaaatcaaacctccttatttgataactataaagccttcttgacttgtcaaataaaagtgacaagtctctccatatttgactttcaatttctcttcagccatattattttaaactcaattcccccaaggacaaacatgttcttatacatctttgcatttccaaaagttgatttacttgtcccaaagattttttctttgcttgacatcttcataaatctctctgcataccactttcctcagtcagactattaattctccagtgaagcctttttctaacacctacttcagccttaatgataaattctccagattacaaggcctctctggtctttgtaacaagtttatgctctttgaaatgagtaactctatctctatctagatatatccagagaccaccacaaaaataaggtacagaatacacggcaatcactaaatatatgttaaaagaacaaataaaaagagaacaaagtaattagagagatagaaataaagatggtggtgctgctgattatgatattagcaataattcatatttcttgagtacttaccatatgccaggtatgtgctaattggtttataaattctattctcactttacaaataaaatgttataatttggctaaatatcctgcctcagcttacaaagtgactagaaagagatgccaaaagagaatgacatcagcatggtggccatcaaggtaacatcaaaattcctgtggagcatgggagcccagtataacaccatatagagtggagcatggtaccctgtatctgtcacactgtatctcctactagatcagatcacagacaggagaaacctcttcctacaaggaaaatacaagctggagacactcattggtcttcatcactgccagatacgaatggtaactgatagaggaggatcttctagtccttacaggccctgagttcagtgtgaaaattgctggaaatctgcacagttgcaacccatccccagggcaggagtcctcatggcatttgcaacccgtatgacctaagaagctatggcacagtcttggacattggagcagagttctgcatagcagcaaaactgcatgcacctgtccccaccaacagccaggccagaggcagtcctgccccataagctggcctcacctcagcagagaggtttgggggcagcccctggactcacatgtacctgcccctagcttgacagcttcctagaggtaaacccatttctctagaggaactcttgctcagttgcttaacacatgcacacccacccctgccccttacagaccaggcagtgaccctgacaattcagaagagcctaccacaaaatttgacttccatgcctgcatgtgtcctaccaatgactagtccaccacccttgccactacaacaccacagtcacaaactgctgtagcctaggcctataataatctcacacatcacaatcaagggttgtaactgaagcatctgcacagagaacatgctactgagttcacccagaaccaaagccaatgctacattctcaaccaacatcctaggatccatttacaggaaaaagctttttcctatgaaagttattccataaattggaaaaagaaattgttctactagatacacagatatcaaggtagggacacaagaaacaaaaaagcaaaaaatataacaaccacaaaataacagggttctttgtctctagcaacagatcataaatgaaagggtatttataaaatgcttgaaaaagaattactaataatgatttcaagaaaactcagggagatataagaggatctagaaaaaaaaattcaatgaaatcaggaaaacaattatgatatgaacgaaaaatgtaataaagagatagatactataaaaaacagaattgttggagctgaagaatttaacaaatgaaataaaaatacaatagagagttttgacaacactagatcaagcagaagaaagaatctctgagcttaaaagtaggcattttgaaataaccctatcagaaaaaaatttaaaaaaaggaaagaagaatgaaaaagaataaagaaagcctatgtgatatatgggacttcattaagcaaacaagtattcacattatacaagtgccacagaaaaagaaaataaccaagtatagtaaacatacttatagctgaaaagttcccaagtcttaggggagatatggacatccatgtctaagaagctcaaaagttttcaatgatttttaacccaaaaatattctttccaaagcacattataatcaaaatgtcaaaggttaaagacaaagaattctaaaagctgcaagagataaatgtcaagttacatataggggaatttccattagactatcagcatatctctcagcagaatctctgcatgccaggaaaaaaattgatgacatactacaaacactgaaagataataaacaaacaaaaagaaagcaaacaaacaaaaataaaaaatttctcacagccaagaatattatatccagcaaagctattcttcagaaacagcaaaataaagaccttcgcagacaagcaaaaactgaggcaatccatcacaattaaaatgaccttattagaaatgctaaaaaaggaaacaaaaggataataattaatattatgaaaatacaaaactcagcagtataggtaaatgcataaccatacccagaattccctggtgctgtaatagtgctatgaaattcttcaatattacagtatgtaggtttaaagtcaaaaaggtaaaaacaccaacagctgcaattaatgactaaggaacacatagaagataaatatacaaattacagtaaccaaaatgcaaatgaaaagggagagggaaaaaaagtctatagtatttttatgtgaccaaagttaagttgttatcagcttaaaataggccactatacctataagacttttcatgttaaccttatggtaaccaaacacacacacagacaaaattatagtaaatgtgcaaatgagaaagagaaaagaaacaaaatttagcattacagaaaaccaccaaaccagagaggtaaacaacgagagaaggaaaaagaaacaaaatatctacaaaacaaccaagaaatcgttaacaaacttgcaggagtaattatttgcctataaataataacatgaatgtaagtggattaaattttccaatttaggtttagagtagttaaaaggataaaaaacaaaatcccactatatgttgcctataacagatgcacttcactgttaaacacagacagactgaaagtaaaaggatggaaaaatatatttcatacaaatggaaaccaaaaccaagcagagatacgcatacttatatcagataaaatacatattaagtgaaaaactcagaaaagacaaaggatattattatataataattacataactaactcaacaagaatttacaacaattatgaatatgtatgcacccaaaacaggtctagcaagtattactagacctaaaaggagagttagatagaaatataataatggtaagagacttcagcttcacattttcagcaataaacagatacttttagacagaacattaataaagaaacaacagactcaaactatacgatagatcaaatgtacctaacacatatttacagaacattccatctacagctgcagaattccaagttttcttaactgcatatggaacattctcgagggtagattacatattaggccacaaaacaagtctaaacagatttaagaagatggagataatatcaagtatcttttatgaccacagaagtataaaactagaaattaacaaggaagacttcaaaaaccttacaaatacatgaaaattaaacagcatcctccacattaaccaatagatcactgagaaaattaaaggagaaatttaaaaatttcttgaaacaaatgataataaaaacacatcatactgaactgtatagaaaataacaaaagcagttctataagaaaagtttatagcaataaacatctacatcaaaacaagaaaaatatttataatcaacaacctaattgtataactcaaggaactagaaaaacaagaataagttaagcccaacattagtagtggaagggaactaataaagctcagacctaaataaacaaaatagagactaaaataattcataagatcaactaaacaaagagttgggttttggaaaaaataaacaaaattaacaaactcttggttagattaactgagaaaaaaagagaaaaaacccaaataaataaaatcagagataaaattgaaacatgattattaagatcacagatacaaaggttgcacacaaagcagaatgccagcatctgcttctggtgagggcctcaggatgcttccatggtggaagttgaaggaagagaccacaaatcacatggcaaggctgagaacaagagagagggagtggggaaatgccacgttcttttaaacaaacggatcttgagtgaagtcattaccactcattactgtggggaagacacaaaggcagtcacaagggattcacccccatgactcaaacacctcccaccaggccctacgtccaacattgacagtcacatttcaacatgagatttgaaggggacaaaacattgaaccatatcagacagtaaaagacatttctcaatagaagaaatacacatggctaacaagtacattaaaaagtgctcatcagtaataatgagggaaatgaaaatgaaaaccacaataagatacaccctcaatccaagtagaatgtctattatataaaacccaaaagaaaacaagtggtggtgatgatgtagagacaggggaacatttacacaccgttggtgggactgtaaatccgtacagccactgtgaaaagcagcacggagattactttaagaattaaaaatagaggccatgctcaatggctcactgttattccagcactttgggaggctgaggtgggtggatcacctgaggccaggagttcaagaccatcctgaccaacatggagaaaccctgtgtctactaacaatacaaaattagccaggcgtggtggcgggcacctgtaatcccagctactcaggaggctgagacaggggaatcatttgaacctgggaggcagaggtgactgtgagtggagatcacacgattgcatttcagcctgtgcaacaagagtaaaactccgtcttaaataaataaataaataaataaaaataaaggtagagctaccatatgagccattgggtataaatccaagggaaatgaaattggtatgtcaaagagatttctgctctcccatgttaattgtagcactatttccaaaagccaatttatggaattaacccatgtatacaaccatggatgaatggagaaagaaaatgtggtgtgtgtgtgtgtgttccatatatacacacatatatatgtatacacacatatatgtatacacacacacatatataaatacacatatatgtatatatggaatggaatactattcagctgtagaaaagaatgaaatcttaccatttgcaacaacatggatggacctgaagaacattatgttaagtgaaataagccagacacagaaaggtcacaagatctcattccatgtagaatctaaaaaaaaaaaaagttcatctcatagaagcagggagtaaagcgaggggagtagggagggaaagatggagagaggttggtgaatgaataaccattgataattacaaggaataggttgtggtattttactgcacaatgtgatgaaaatagttaacagtaaggtattatatattggaaaacagaaacgagaggattttgaatattctcacctcaatgaaatgatcaatgcatgaggtgatggatacactcgataccttgatttcatcattatacaatgtatatatgtattaaaatattacattgtatgccataaatatgtataattacaagatttcaacaataaatttaaaataaatgcacaagtatgatgtcagaattggaaccatgaagatgaaactcaaagactatattctcgatcaatacaaatttttaactactaaagaataaaacccatgtaagatgttttggttagatggtacagtttattttgcagaactcaccttcatccgtgtaccttttttgaaaactcaaagattactaaaagagctttgaaatatcatccttatggtttgttttatagcctgagttttacaattcacatttaaactccttggtaattttttaaggatttttcttctacttgagtctcaaatttcttatgaactatgacaagactaaaagatactgagtgagaatagaaaatagaaacaaacagggccaggtgtggtgactcacacgtgaatcccagcactttggagactgaggccagtgaattacttgaggtcaggagcttgaggccaggctggccaacatggggaaaccctgtctctactaaaaatacaaaaattagccgggcgtggtgatgcgtgcctgtagtcccagctactcaggaggctgaggcaggagaatcacttgaacctgggaggtggaggttgcagtgatctgagattgagccacgagccactgcactccagcctgggcgacagagcgagactcctcaaagaaaaaaaaaaaaaagaaagaaagaaaggacaagctgctgagtctcttgcgcaagacttctgctgctggaggcttgataatctcttttattgccacttttttttttttttttttttttttgctccagacatttttatcaccttctggtaatttttcttcacttcacttcaatctgaattgtagcctttctgaaagtatttatcactgtgattttgtttgctgtagcttattaaatgcccttttggtcctttttaattgacctttttaaatatgagctcatcttagagaactatctttatatctaaaattagtccttagaagttcctagttgtatttcttatcagggtcacttgtaattataatgtcagacttttagaatgaaacataagcatttgtcacatttagccatgattggtattcttagcactgaactggtttccttaactctagtaagttcctttctaatttataaattatgtcaagtttctaatgttttggattaaattctaaaggatattatcacactttccaaccatgtctgtcatcatgcacattagtttactagggctaccataacaaagtggcactcagtaggtggcttaaggacacagaaatttatgtcctcatagttctagagactagaggtccaaaatcaagttgctggccatgttgtttccttctgagacttgtgagcaagaatctgctctgtgcccctctcatagcttccggtggtttgctggcagttcttagtgttctgactagtaaaagcatcactctgatctctgtattcatctttacatcaagctctccttgtctgcatgtttatgtctaaatgtctcctttttatcagaacatcatttgcattgaattagtggcccaccttactccagtatgacttcatcttcactaatgacactgcactgatcctatttccccccaaaatgtcacattctgaagcactgagggctagaagttcaacataagaatttggggggtggggagacaccatgcagtctgtaacatcatgtcacttgacacagcaaaaccactaatgttttccattaccccgtaggacaggcaaaccctaccttgcctataagacctatcacaaggtgtctgtaaacagtgttatgatagaccacctcttccattagcccttatcctcaaatacttgtctattcaccaaaaacaaagcatgttgtctgctttctgacactgccttgttgctctatactttgcctgcttgtatgtatgtcattaggatttctcttcaccgacatagcagttaagtatgttccatgtgtctttttgtttatacattcccattttgctatatattgtgagtataaaaaaaacagcagccaagcctttcatgtctttgtaacacccacagggcccataaaagtgtataccacatagcaggtactatatattgttttctttaagagatgaaaaataaagaataaaaagtgaaagactagtcattatactaaactaatctacaataaaatgtttaaaattttaacattttgatttaaaaataatattaaaatatattaaatatttaagcctaaacaccttattaatcataacaccatttattaatgtatttttaactaatatgttctaaaactacatgaatgtgagtatggataaaacatgtcttcaaaaatttgcagactggtaggggagatggacaatatataaggaaatagcagaattgagggaaatccattccaaaagcattgttttggaaaaaaaattatatttaacatgtttaataaatattttgtaagaaaattttaaaaagaaagttattgtaacttagaaaattaagggatcttcactcccagaactgcatttttaagaaatcaatggacagacccactccacaaccatttaactgcttaactggaaaaaagggtgtgtgtgcgtgtgtgtgtgtgtgtgtctgtgtgtgtgtagtttctaaaaattgtcctaagagcatacgtcaaatggagaatcatttattcaaggaaagctactaaatcttaatcagaataacaataatctgtgacatttgagccagctgcctgctaccacctctgtgttcagttccatgtgatggaagagctattctgaataagtatggccaagaaggcatggctttgtagcccccctgctcccctcttaggagttcagtttaaaccccagaagaggcacacccaccagcatgaagcacccccaccagcagaagcacacccaccagcagaagaggcacacccaaaacccttcggcttgtgcagcaggagctctttctgaggcaggcatggttaaaattgaggctcccttctcccactgaacatacactcgttaagaaaagctttatccaaggaattgcagatgaaaaatactggaccctattgtccaaacctagcccacttatagggtgtagttttcttgccaggaggagaaaactaaaaaggacaaatgctgccatttacatctagcaccctcctcgtagagtaggggtgcccctccgtgaaaagcagaaaattttccctgtccccatgtgtggtgcagagtttctgccaagagtgaggcatgccataaggacaaagagcctcacagctctccctaagtgaagtagtgttctttgaactaatttcgaagggtgtttcagaaaacaatgtagatttggttggtgagcagttaagagggggtaaaatggtagaccagctacaagtttaacacatttgtgcctgagattcaatctttttgaatttttgcaatcagtccttggcgatggccttgagcagtatgatataaataactctcacatgcttagtgtttcaataatggaacactagacataagtgggaagagagataaccaggaaagaggacagctaaggagccctcttcagttaagagcaagctcaaagaaggacaaaataaccctactgccgcaaatggagctccaaacttaattgaatcagactgtagaacaattatgcccctgggtcttgtcaaaaataataaagcaatcagctagcaattaatggaagccgacagctaggtgtgaaaccaatagaggcagagcagccagaaagttaacatgaaatcaaggaaagaaacagtcaaaggaaatctggaaaagccacatccattactttgtccaaggaatctgtgcacatgagcagtaatatgtcctctgagtctgcacatgcaagaaaacagacttcgctgaacaaatctagcctagctagtaacaaatgaaacaacagcagcagcaagcttggagtgcagaatcaatatgcagagttgctacaatatattatttaaaatgctgagttttcactgctagatgatccgaaagcagtttcactgatgaggatgctaatactgtatattttgagtgtttaaataacactatgaaatgtgagagtaggaaatattatattactaatttttctgaaatatgctattttaatgtgtatacaaataaaatatatttttgatgaaacataaaatgttcacttttcagaaaagcactgtaaaacatgcaaagagacaagaaggtgtcatccatacacaaaagaaaatcaagtgatagaatttgtttttgaggggtcatagatgtagacttcaaagcaattattgtaaaaatattcaaacatttaaaaaattacataattaaaagatggtatgatgataatatctaattaactagagaatatcaacaaaaataaattttataaaagaactaagtgaaaattctagagttgaaagtagaataattaaaacgaactattcactcatggggctcaatagtatatcaaaacttgaagaataaacaatctatgaacttgaagagacaaggatagagattatatcatctgaataacacaggaaaaaaagaagaaagaaaatgagcagagtctaagagaaatgtatgatgccattaaatacataaacttacacataatgagattaccgcctgatgagattaccagaagagaggacaaagaaaaaggagcaaaaaattattttaaaacatagtagttgaaaatgctctaaatctgattaaaaacattaatttacacaccaaaaagttcaacaaggtctaaacaggaaaaatgaaaagagacctaaatctatacatatcacagtaaaaatgttgaaaggcaaagaagaaaatcgtaaaaagattaagatacaaagggatcaccataggattaatagatgacttctcattatttacaaggacattgccatggaatactgaagtcagcgtaatgacatattcaaaattctgaaagaattatgaaccaagaatcttatatcaggcaaaactagcttttttcaaacattaaaggagaaaatcagtcacagtggctcacacctgtaatcccagcagtttgagaggctgaggcatgtggatcacctgaggtcaggagtttgagaccagcccggccaacatggcaaaattctgtctttcctaaaaatacaaaaattagccaggcatgttggtgtgcacctgtaatcctagctacccaggaggctgaggcaggagaatcacttgaacctgggaggtggaggtggcagggagccaatgtcacaccacggcattccagcctgggcgacagagagagacgctgtctcaaaaaaaaaaaaagaaagaaagaaagaaagaaagaaagaaagaaagaaagaaagaaagaaagaaagaaagaaagagaaaataaagaagaaaagcacatttccaaataaacaaaaactgaatttgttcctagacaatccatcttaaaagaacgactaaagatgtatggttttccatatgatatatatggatcttggaagttgtcaatttcattcacactataagaaaaagctgaacaaactgaaaatcaaaaactcttagatccttcagaaaactgagacaataggagaaattgctgccacataaattgaagaagcaggaaggtaaatgcagatgaatcacaatttttttggaatataaacctaggagaagaaattttcatgagacacagtctggggttgggaaaccgaagctgtaattgataaactggtggatgagtattaatagttccaaggagtacctgtcttagaagggtttcccacacttttatgtaagttttgccactgagagccctaccaggttttcaccaaaaagattggagaaaaaatcccttatgcttctggcagagggagaaaaaagcaactgttttgaaatacacctgggacattctgttcttaacaagaattaccctcaaaaccaaatagtttactagagtctaacaaatggtttttaccagagtttaagcaactgagaggaaggaaaatatccaacttcagcctctctctagatttcaatgtggcagggggaagaacaatactcaactgcaacccactccaaacttccacattgtattaaggacatacctagctctagtcccttgtagcatttctgtctcaccaaagcagaggagactgaaaaggatttgttaagtcacaacacagaggcacaagctcactaaaaaacagaactaagcacgggactatagtacacttctccacacacaacttacaaatgcatcactaaagtactgttgaatgcaggttttttcacccagtacatcacatccagcttttaacacacacacacacacagacacacacacacactacacagtattctaaaaagcaaaagagagtttgaaacaacaagaaaaaataagcataagaaccagaatcaaatatgggaggaatggtgaaattatcagaccagaaatgtaaaataaatatgactatcgtgttaagagctaatggaaaaaaaaccagacaatattcaagagtagataggtaatgtaagtagagaaatagcaattctaaaaaaaaaaaaacaattaaaaagaaaagcaagaaattaaaagtattgcaaaagaatgaagaatacttttgatgggcttattaggagaatgaacatgattgaagaaaggagatcatggaacatgaaagtttttctgtagaaacttccatactgtgggataaatacaatagctataacacatgcataatgggaatactagaaagagagagaaaaaaaggagcaaaatatttaaagcaacagttactgatagtgacaactcttttacaagattaatttcacagagcagactacatacccaggaagttcagaaaacaccaagcacaatacattgcaaaagaactacatctaagcatattatattcaaactgcagaaattcaaacacagatcaaaaaaacatgaaaaagtgaggtaggggtgacaaccttatctgcagatgagcaaggataataattgtatcactcttgtcatcagaaactatgcaagcaagaagaaaatcaagtaaaatatttaaagttttgaaaaatgaattctcatcgatttagaattccattcaagtgaaattattcttcaaaagtaaaggagaaataaaacttttccagataaataaaaattgtggatattgttgttagtagccctatcttacaatgaatgttagttcttcgaaaaataggaaaatggtataggttagaaaccttaatatagttttcaaaatgaaaagcactagagaaaaaataagtaaaggtaaaaattttttttattcttagttgatcaaatagacaacagattactactaatctgttagttgctactaattattagcaacaatgtacccagtggatataatttatggataagtgaaatgaaagtaatgacagaagaaatggtaaggcaaaattgggaatattttctattaaggtacttgcactctctgaaaagcagtacattataatttgagagtagacttgcattagacgtaaatgtaaattgcaaattctagaacagccaataaaaaagtgaaaaaaattataactgacatgctaaggaaggaaagaaaacagaatcacataaaacattcaattaaaaccatagaaggctgaaaaagagtggaggataaaaagacaaacaaggaacagaggagaatagattataaatatatcatatatgaatgtaaatttattaataatcactttaaatgtcaatggtctctatgcacctattaaaatatagagaatttggcaggggtccctaaccccagtgtatgtgctcagatcacagtaaaattaaactggaaatcaataacataaaggtagctggaaaaatcaccaaatactagaagattaaataacatatttctaaataacacatgggtcaaagaagaaatctcaagagatgtggaagatattttgaactaaatgaaaaatagcatactaagatttgtagaatgccatgaaagcagtgattaaatgtaaatgtataacattgagtgaccatattgaaaagaagaaagatcaaatcaataatctaagtttccagcagaggaaactatagaaataagagcaaattaaatccaaagtaagcaataataattaaaattagaacaaaaatcaatacaattataaacagtaaatcaagagaaaatcagcaaaccaacatctgtttttttgtttttgtgtttgttttgagacggagtgtcgctctgtcacccaggctggagtgaagtggtgcgatctctgctcactgcaggctccgcctcctgggttcacgccattctcctgctcagcctcagagtagctgggactacaggcacccaccaccacgcccagctaatttttttatatttttagtagagacggggtttcaccatgttagccaggatggtctcgatctcctgactttgtgatccactcgcctcggcctcccaaagtgctgggattacagacgtgagccaccgcgcccggcccgaaatctttttttttaaaagatcaatgaaatcaataagcccaggctatctaaaaagaaagaaactatcaagctgtgaaaagacatggtaaaactttaaatccaaattactaagtgaaagaagaaaactggaaaaacaacatacaatgctactccaaatatatggcattctggagaagacagaactgtagagagaatttaaatcacttgttttcagggattagaggaaagagagagatgcattatcacagaagggagaatttttagtgcagttaaaatactctgtttaatattaaaatactccgtttagcagtctattttataatggtggatacatgtcattatactcttgtccaaatgtatgtacacaagagtgaaacctaatgtaactatgaacttttcgtgataatgatgtgtcagtgtgggttatcaattttaagaaatgtaccaccgtggtgggagatattgataaggggataggctatgcgtgtgtggatatggtacatttctgtaacttctttttaattttgctgtgaacctaaaattacttgaaaaataaagtctttaaagaagatatatatttgaggtaaagacatggagtacaaaaggaagaagacaagatgataagacatatagaaagaaaagcaaaatgacaaacgtaaatctaaccatattagtaatgttattaaatataaatggattaaataaggtaataaaaaagcagatattatgaaaattaattgaaatggaaagtgtctctaggagacacaacttagattcaaagacacacgtaaattgaaactaaaatgacagaaaaagacatataatgcaaatgatgatcttaagatagctggtgtggctatactaatagcataaaatagatttaaaggttaaaaaatttactactaaaaaagtaacttcatttttaatgaatttaaaattcatggggaggaaataacaattataaaaattataggcatcttacagaggaaacacataaagtgaaaacacaagtttgaatgaagaactagacaatttcacaatagtagctggagacttcaatacaggtagagcaagcagaaaaagcacaataatgcagaagacttgaacagctctatgaatccttgctaaccccaacagacatgtgtagaacacttcactcagtgattgcggcatacacattcaagaacacatgaaacatctgtaggacaaatcatatgctaagccataaaacaagcttcaatacatgtaagaaaattaaaaccatcaattgttttctctgaatgcaatggatgaaaagcagaaattaataacaaagaagatgtggataacccacacatatatgaaaattaaacattaagcattctcgaataaacaagatatcaaaatgagaattacaacggaaattagaaaatacttgaagatgagttaaattaaaacactgcataccaaaacttacgggatccagataatgtagcgtttacaaaaacactacattatagctgtagtctattatattaaaaagcagaagaatctcaaattaataaccataattttatcttaagaaaccagaaaatgcactgggtgcagtggctgatgtctgtaatctcagtactttgggaggctgaggcgggaagatcgtttgaggtcaggagttcgagaccagcctgaccaacatggtgaaaccccgtctctaataaaaatacaaaaaaattaattgcatgtggtggtgcatgcctgtactcccagctactcagggggtggaggtaggagaatcacttgaatccaggaggcagaagttgcagtgagcagagatcgcaccactgcactccagcctgagcaacagagcaagcctccgtctcaaaataaaaaaaaaaagaagaaagaaaccagaaaaatgaaagtaaactaaacccaaaacaagcagaataaggaaataataaaatggaaacacataaaaatatagaagagaaaaataattaaaaaaaattaatggtaccaaaagttgatactttgaaaacacctgcgaaattataaaacatttaaatagagagaagacttgaattattcgaatcaggaatgaaaaggagaacatcattactgagcttgcagaattaatgaagaaggtaagagaatactataaaaaactctatgtcaacaaattagataatttagataaagtggacacattaccagaaagaaaaatataccaaagtaactcattaagaaatacaaaactagaatagacctataaataataaagagttgaaccaataattttaaaaacttcttccaaggttaaaagctcaggtcaaataatgttactggtaaatccttccaaatatttaaagaaaaatttacataaatgttttacatatgattctaaatatttaaaaaagagtgaacactcctaactcattctgtgaggttattaataccacaatatcataaccataaaaagacaacacaaagaaataaaattaccaccaaataatttttatgaatatatagcaaatatttgcaaaacagcaccagaaaatcaatcccagcaacacatagcattatattccacaacccggtatcacatattactagaataaaaagttggtttaacattttaaaatcaataatctaatacatcatattattggaataactggaaaccaccggattttcttaatagatgtagaaacattatttgtcaaaatataacaccattttatagtgcatacactcaggagactggacatagaaaacaatctgatcaaccttataaagggcatctataaaaaacctatagctggcaatattcttaataatgaaaaaccaaagcatttcttggtaagttctggagcaagaaaagagtatttgcttttgtcacttctattcgaatttgacaggaagttctagtaaggcaattcaccaagaatatggaataataggcatccatattggaaataagtaataaagctatttttattttcagatggcatgatattataggtagaaaatcctaggatctacaaaaatttagagttaattaaaagttcagagagacattaaatcaattgtatttttataaagtagtgatgaaaaacctttaaatgaaataaaaaaacaattacatttacaatgatatcaaaaaaatgaaatactttggaataaatttcatgaaagtggtataaaacatatacagtgaaaactagaaaaaaattaaaagaaattttttaagaaacctaaatgaatagaaagacataccatattcatagatagtaagaacactgttaaaaaagctatactttacacattgatctacagattaaacacaatttatatcaaaatcctagctttttttttttgcaggaattgatgagctaatgctaatattcatgtggaaatgcaaaggacctagaatacccaaaacaatcttgagttaacagaacaaagttggaggactcacatttctagattttaatactcacttcaaagccacagtgagcaagaagtataagactggtataaggaaagacatatataaatcaatagaatagaattaaaattccgaaaaataagtctcacatttatgccaaattgattttcaacaaagatggtgagagaattcagtagaaaaatattcttttcagcaacttatcctgaaacaactagttatacgtaagcaaatgaatgaagttggatcatgtcctcaaatcataaacaaaagttaacttaaaatagattataggtttcaatgtaagacctaatactataaaaatcttacagagaaaatagaagtaaattttcctgaaatttgattatgcaatgacttcttatgacatgaaaacaaaaatacatgtgatgaataaatataaataaattaataaaattaataattttggtggggcatatggtaccacaacagaagtgaaagacacagaattatgtgtgtgtgtgtgtgtgtgtgtgtgtgtgtgtgtgtgtatatatatatatatgaatgatacaaatgttaataagaaattaaataaagcagtaaactttctccttaagctaaccaaaaaaagcgaaagagaagtagaaatcattgtgtgattcttgccccccggttttgagccacagtgctactcttcactttggaaactccactttaagcatcagtgactggaaaaatcccctgaagccactccccttgggtattttccacttgctcagacatctctgtgtaggaacgttaacaagatcaccacgccccagagaagctgtctgtaaagaacatttatatttaagacaccctttttttttcatagttactaaagattttcattctgctatccttaggacatactttaaattcttaaaaatgataaccatttctcatttgtcaccatatctaagcaaatagtatacagtgtaatgaagttctaaattttctttcagatgtttacaggtttttcttttatgcctttactgtgttattaaagtttaaatgtatgaaggtttttttagggttaacctaaataattttatatagcagaaaaagtatttttaaatcatatgtctgataagggatttgtagccagaatatataaaaacttctgcatctcagtaataagatgaaaaatgacctagttaataagtgggtgaagcatttgaatagatatttctccaacaatagtgtacaactggcaaatatacacatgagaagatattcaacatcgccagtaatcagagaaattcaagtcaatctatgagctatactttacatacacaaagccggctataataataaagtgataggcaatacctacagttggtgaggttgagaaaaaattagaatgctcatctattacagatgagaaggtaaagtgctgcagccatatgaaaaataacttagcagttcctcaaaatatcaagttcccacatgaagacagcaaggcttattcaaaattcaaaagtcaatctatgtaatccaccatattaatgggctaaagaaaaaatatatagtagtatcatttgatgcagaaagcacatttgacaaaaaaattcaacacttgttcatgataaacatctcatcaatttaagaattaatgagaactaactcaatagagagaatctacaggaaaaatagatactgctaatgtattcagtgatattgtgagttctttccctagaaatcatgaacaaagcaagggtatacatgctcaccacttttattcaatacagtactagaaggtaaagtcacacacattggaaaggaataaataaaactattcctgtttaccaatgacgtttttgactatatagaatatttcagtgcatctgcaggaaacttccagaaacactatatgagtttagcaaggttacatgacgcaagacccacataaattgatttgcatttccatgtactaataataaacatgaggaaacaaaaattgaaaatacaataccatttaaaatgtatccacaggaaaattatttggtaaaaatttaacaaaacatgtataagatctgtatgctagaagtcacaaaatgttgctaaaatgaaatcaacctatatttaaataaatggagagacatattatgttcatggatccagaagtaatggaagattcagcacagtaaaggtgccaattcattctcaaattaatctatagatttaatatccatcaacatctagcaagtttttaaaatagacataagaaagacatattttttaaatagacataaaataaacatatatggaaatgctctggtcctagagtagccaagacaatcatgaacaaaaaaagagaataaagtgagaagaatcactctaaccagtactgacctttaataaatagctacagcaaacaagacagcatggcactggaggagggagagatacacagatcaatggaacacaattcagtagagaacctaagaatacgtatacatactcatacatattcaattttttttttttttaatttttaggcagaggctccctctgttgcccaggctagaatgccgtggcaggatcttggttcactacgacctccgcctcctgagttcaagcaattctcatgcctcagcctcccgagtagctggaattacaggcacacaccaccacacccagctaatttttttgtatttatagtagagaagaggttttgctatgtcaccctggctggcctcaaactcctggcctcaagtgatatgtctgcctcggcctcctaaagtgctgaggttacaggtgtgagccatcgcacccagcctcaaccagtttttgaaaggtacaaaagcattttatggaaggtagggtggccttttcaccaaatgatatttgagcagttagatttagtgggccaagtaaaaggggctaaaccttacatcttatacaaaatttaactcaaaatgaattactggtttaaacatgaaatgtaaaactattcaacttaaagaaaatatctttgatatctaaaactgggctaagaattcttagtcctaacattgaaagtatgattcataaaaggaagaattcataaattgggctttataaaaattaaaaatattcaccatataaaatacctgtttaggaaaagacaaactacaggttgaaagtaaatatttgcaaacaaataatataatatctagaatacataaagaacacttaaatttaacatggataactgagaaaatttgagcaaaatttgttgattttattactgtcataattatggtcatgatagtgtataagtttgcccaggtgttaccactcggggaaatgctataaagtgtaaactacgtctctctatattcattcttacaactgcttgccaatctaaaattaatgcaaaataaaaagttaaggaaaaaaaattatgtgccagcaaaattgcgttttaacatcctccacagcaacctcaaagtatggtactcacattggtacatacaacccagcagtccaaatatgtatatttatgtgtaaacttttagtactgaccacgtacaacagcttgcatttggcaaaaagataatttgaaatagaaaataaagagaaaaaaaacagagttttttccttcaaggattctgtaaggtagtcagaaaataagacacatacaaatgactgtggtacaggcagtatgtggggagttacataaaagacgtatacacatttactctatgagcttaggaggaagatagcaatgctttttggaaaagttcatggaacacaggacttctgcagtaaactttaaggacaaaaagattttttcttctttctccatgtgtttttaattcttgtttaatcctttctttatcattccttatgattgaaaataatttttaaaaagatttttccaagtataagttagtaatggggtaacttcagggtaaatccagcatgaacaagaatatcaaagcagaaaacatgagctagcagaatacaatcagcctatttcttccaaagcaagagctataatatatgatgacagcagaaaaagatgcaggccagattttaggttttgaatgccaggttaagaattttatttttgtcctatagagtgacagacgctattaaaagtgtttcagtggggccacacagagatgaaacaggctatccaatgaaaatgtgtatgtgaaaactttcagtcctatcatagatatagaaagaaaaagaaacaagaactataaaaagagaaagctgtactgtggatagttctctaacaaaatttaaccaataactctcttatcatcttgctggatcttcaaaaaagtttatgaattcaacacgaaaaatctgttatgattggagatcagagaggtatctcataattttgctgtcataatcttccaagtcagaggaattgagatctgcatggcctttgaaggaactaggttgataagctagatttgagaacttttcctccctgtgaagtcaatgagggaaggaaactcactcctattcaggtctctgttgtcattgctttgcatagtacttggaacataataacagatcaacatgtattttgagtgcattatgaatgaagacaaacatgagataaaatcaaaaggcttagcacatattgattctgagtgtaaaagagaaagaaagacctaaaaacaaagagctgttcaagccctgtttctggtaagaatagagtttcaataaagaatcaggaaagtcacagccacaccgtgtgaattatgagccaatcactgctcagctgtttgcgatgcctttgggtatagttggaagacgataaaagttactctaaatatgtgcttgctgcctctgtttttgccatttacaaatactcagagacagaaaaatagatgaatctgattattttttctaaaggagaacatgagatactctgtaccaaattcaaataaaaaatgagtgctttgagattgcatgattaaatagaataacaacatccctggcaaacgtgattaagggagaagattatagaagcatgtgagaaatggaaagtgttattaaaaatatgtcagcttttggtatatcatccctaaccctttcagaagatccattattatgccaacaaatttcgtgtaagaataatgatagtgacatttactgaagaactacaaacaatataactttccattttaatgtttcatatttctcatgtttatctaagactcagaaaggttttaggtttgtattcaaattcaaggtgtttttattcacttctttttaaaattagtaaatattttattttggcatctgcataaagtctgaaattttatgaaatgttctgaaaatgaataggcagtaagttttaatgggctgtagctttttaagctgtttttgtggctgattaaatttataaggttttatttcatatctatatagatttcttataactattggctttccaaaaactaaattatcaggcaaaaaattaaggtataattcagttttctttcatcgggatggttcaactgagctttttagagaggtagagagtacattcgtatgacagttgacctcctaaatatttcatcctgaaaattccattactaagattctctgggaatctctgggaattctctgggaatgcttttgtttaagacataaaatatacatacctggtgttatgatatgaatgcctgtgttcccatgaaatgaatacattgaaatcctagctccaatgaaggattaggaggtggagccttttgaaaggtgattaggcaatgaaggcaaaaccctcatgggtgagattaatcccctcataaaagagaccccagggagctcttttgtttttttgaccaggtgagagtacagctagaaggtatcatctatgagccagaaagcagccctcaccagatatcgaatctgcctgtattttttattggacttcccagccttcagtactgtgagaaataaatttcaattgtttatcagccacacagtctaaggtgttttgctatagcagccaaaaggaactgaaacatttagttatatatatcatcaatttggtaattatttgcaaactgttgaggttttctcaaatgtttatttggctagtctgcattgtatttccaagaattaccctttctgtgtgtttctggttacagtgggccacaggagatattcttctgggacagttcaagtgtcaaagtgaagcagcagcttttttgtagctcacatatacatttgctttcatgcctgcaactttctgtctttccctggatcctctgtcagcttctttgattcctgggccaggtgtgcacagaactttgtgccataacaaagagacctggtgctgtaaggcaccaggacatgaagattgttcacagcaaaaattggcactggcttcagccttccctgaggacttcagctcttgcttgacgggtatagatggttcttgttctctttggctttctatgcatagttccctcccaatggccacaggatacccgtggactttaagcactagtatcagactagaagaaaagagccatgaaccttgatttgtatcatgtacatgtgtacgatgtatcatttatatcatacaacttgtaattctacactttctttttttatagacagagtctttctctgttgcccaggctggagaacagtggcacaatcatagctcatggtaacctcaaactcctgggattaagcaatcctcctgcctcagcctcctaagtagctgtgactgcaggtgtgtgccaccatgcctggatacttaaaaaaaaaaaaaaaaattctagagacagagtctcgctatattacccaggctggtctagaactcctggcctcaagcagtcctcccatgtcagccacccaaagtgctgggattacaagcacgagcatatttttaaatattagtgtttattcaaattttttataattacaaataagaaatagttatctgaaattgtcttgggagaatgatgaaatttgaatcaacatggtaaatggttaggatgctgatgtttagaacagttttaagatatttttaacaaatcttaggatgttatattataagggctttgagggaaataaaagcagccttcagaatacaattgtgaagtttcatactaagagcctcatacaaacacttaatccaaaatggttcaaaatgttttgaaaaacacaagttctgacagaagtctgcacaaaatccacatactttgtcattccttcatttgacacattgatgtggcatctataacctgtgccaggcactgttctaggtctcgggttatataaataaccaaaagagaaaaataattctgccctcttgagcttatactcaggaaagaaataaaacatatgataactgcaatagtaagatgctgtgtgtaggttaagtcattttaagcattatgaataaaattgaaagttgttcggtgtcatgggtattggaaggattggaagcactaaataggagcagatgcatgatgcagtttcaaacagaatgatcagtgtaggcctcctggggctggcatttaaacaacaatttaaagaaagagataagagggttaacaatggtggtgacgaatatcttaaattctgggaataatcatgccaaggtcctaaaatgagttttggactggtatgtttggtaaggaaggaagcatgtttgactgaagccaaagagggagaagagtgatgagagaaaagtcagatatttaatggaggatgtcctggaatggcagtatgaaaagacttaggaatcatcttatttatttagaccctttttgattcatttcatcaaaactttacagttttttacatatagattgtgcacctacttaattaaatatttatctaattatttccttttttggttctatttcaaatttcaattgttaaatgctggtatataagagcacaactgaattttgtgtgtcagtttttgttgttgttgttgttgttgcttttgagatggagtctcgctctgttacccaggctggagtgcaatggcgagatcttggctcactgcaccctcgcctcccaggttcaagcgattctcccacctcagcccccctagtagctgggattacagatgcaggccaccatgccaggctaatttttgtgtttttagtagagacagggtttcaccatgttggccaggctggtctcaaactcctgacctcaagtgatccactcacctacgcttcccaaagtgctgggattgcaggtgtgagccacagcacccggcaatatataaatcatgtaccctgcaaccctcttataattacttataagagtattttttgtctattattgggattttttacatatataattatactatctgtggaaaaataaaaaaaaagtttttacatttcttttcaatttgtatattttaaaatttccttttcttgacttattgcattagatgagacttccagtacaatggctaatagcagtggggagagaggacattcttcccttcttccccatcttaggataaagacacctcatctctctgactcgtgaagtatgatgttagttgtaggtacttttggagatgctctttattaaattgaagaaatctctctatattcctaatttgctgaaaggttttaatcattgatgggtgttattttctcaaccaaatttctgcatgtattgatatgatcatacgattttatctttagcttgctgatgtgattgattgattacataattgattttctagtgttgaactagcgtcaaatatgtgggataaattccactcggtagtactatgtaattcttttgattatttcgattacaattctataatcctgttgaatttgatttgccaatatttttgaagacttctcacctatatttataaattatgctgcagttttccttttttttataattctttatctggttttggcattacggtaatgctggccttctagagtgaattagacttctatattttggaagggattttaaagaattggtgacttttcttccttgactatatagtagattttactagtgaaatcatccaggtctggtattttaaaaaattattagttattgatttattttcttaaatgaatcaacactctaatagtgtttgtcttttaattgatatttagacaactgatatttaaagtgattacttatatagttagattacctacaatatgtgtaattgtttttatttgttatatttgttctttgttattttttaaatctttgtcttttttctgccttctctgatgttagtgaatatcttattacatgatatttcttttcctcttctagcatattagtttatatctttaaaaaatatttttgtgtttcttctagagtttgcaatacgcatttacagtaatctaagtccggcttcaaataacattataacacttcacaagtagtgcaggtaacttaaacccctgtgtaaaacatgaggtgatttttctctattcttcaccattagaaattgcggtgctggaggtagaacccatgaatttgtggagctcctaccccacctaagtccgggcccccaggcacctttaccttcaagcttcaccacattcagcccccagcaattcattagttactgtggaaattttcctgcaagatatggactccagcgactactgctctaagttgatcttgactgtaagattccctgcatttgcttgtcttttcagattttagggtggcattttgccccatgaccaccattcttacttggatctaagaaaagataacttgtttctctttgctctggtttctcttgaggaggatggagtgatgctttcagatccccagtgctgaaatcagaagtcctccaactaacaaatatttaatgtgtttatttggtaaccaatgtctattttattttttaacttattttacttctgctaaattttgaatctctacatattttatttcaatatataacaatacctacgtaccagagacatctagaagcataactcatttaaagagcaagaactagggagacagctgtgatttgccacagtacaggcccacggcattctgcttgtttgttaattggtagatgatggaacagttcagtgagtcattgccacactacagacctacaagctctcaacactcacaactgtgatacagctagaaaatgttcttagcagtatgctgtgacttattctaaattcgtcatcagcattcaacttaggttttagcacacatatatgtgcaagtaaattttatatatatatatatatatatatatatatatatataaatcatatattaactaactaaacaaaaaaatacaggttcttgtactttaatcttccttttgtaatatacctagaaggcaatgattttaacattctggaaggaaactgtcattgcttttttcctcttcattttttgtaaattaaaagcaccaggactcatttgggcaagacactgattaaaccctaagcctaaatctatgttgagtttttaatcatttcatgctatggaataaatgtaacaagcactggtgtattcatctgcctctctacctgaagtattaaatatcaaaaataacatttttatacataaagctctagaatatacaaattattctaaattaaaataagtttgtcttagccaggaaacacagtgagacctcacctgtataaaaaagtaaaaaattagttgagcatggtggtgcattctttttttcttttcttttttttgagatggagtcttgctccgttgcccaggctggagtgtagtggcatgatcttggctcactgcaagctccgcctcccaccattctcctgcctcagcctcccaagtagctgagactacaggcacccaccaccacgcctggctaattttttgatttgtagtagagatagggtttcactgaattagccaggatggtctcgatctcctgaccttatgatccacctgcctcggcctcccagagtgctgggattacaggcgtgagccacagcacctggccaaagtggtgcatttttgtagttccagctactcgggagcctgagatggaagactctcttgaacttaggaaatcaaggatacagtgagctatgattgcacctttgcactcccgcttaggcaactgagcaagaccctgccaaaaaaaaaaaaaaaaaaaatgagtttgtctttcacagaacatctaaactggaaacacattataataatataatgaataaatctaattatggtttaatattcttttatactcaattaactactgtggctttattagattacagaaactttttcagacacagacaaattatatgtatttttgaaatatttggtaaatcattaaatgaaataatttcttatcgaaagtaagggagacctatgtgatttcaatctattttgaacagagttgaaaataatactatttggctgatagttgttataaaatggaatccaaagcaacattaaacaattgtgtgatatgatcttacattggtataaatagatattcattctttgtgcagaggtgtaggtattctacaaacttttcccaagctccatttccaagttgtatacttaatgcatcaaaaaatcataaccttttctgagatattattctcttctgtcttattaggaagacacctaatcaggatttgtataaattaagtttttattaattttatttacatgtactcattattttaattaattataccgtattaattttatcgatggttatgaaaggtacctaatcaggatttacattaactaggaagagcacgctggctcacacctgtaatcccagcactttgggaagcctaggcaagtggatcacttgaggtcaggagtttcaggccagcctggacaacatggtgaaacccagctgtactaaaaatacaaaaattagccatgcttggtggcgtatgcctgtaatctcagctgctaaggaggctgaggtgggagaatcacttgaacccaggaggcagaggttgcaatgagccaagatcgcaccattgcactctagtctggccacagagtgagactccatctcaaaaagaaaaagaaaaaaaaggacttatattaattaataaaaattaattccatgaatttttctttctctataattttaaggaaaggtgtaattttctctcattgttgaatataatatttttcaaagacaaagagttgcttagttatttataggtctttaatccttgtaactgcagagattgttttcaactggctttgtactttatgtctgtctgttggctttggccttgttctttctgcctcagtaaaagtataataatgatgcctgcctaattgaaatggaaatctcttcagaaatccctgtgattgaatttattgtgaatcataaacaaggactctttatgacatacaaaactttgcatatggattcatagttaaatgtttaggctgttataggtggcttatttatcaaatttagtgaccccttttagtattctctcaatcatatgtttaggggaaatataaatggaccctaaatcagtaatctcaaacatgaactaaaggagtctatatgaaaaaatgctaaaaaaaaatttggaaaaatgtagaatttttttaaaccttaaattgaatcaagtacagttacatatctaaagaaacaaacatcagacatctttcaattagccacagtgtttcagataaggccaatatttatacctttaacttaacttaaaaaattcatgtctaagagagcagtttacagttattagactggcatttactgctatataaatttcagaaatgtttataacattatcgaagtcctttgagggatcattttgatattgtcattgttacaaagttatagaaataaaggctaacacagttcacatcataatttagaagaagatgagtacaagatacgagagtatgctttcaaatattttctcacatctattctttatgcaatcaattaatgaatatttatcaaaagcttaaatgatgcataaaaaatgcagaaaaccatggtcgacacctaaataatttacaatctaattgagaaaaataagttgatttcacttatgaagcatgggtatttgacaaaagcaataagagtattggtaaatccaaaaaaatgctcataagaaatcaataaacatgtggaaaatggccttgagaaaactcttttaaagatgtttttgatttttggttcttgcttcttggtactaaatgaaaaacaaaatctgagtaaagcattatgaaaatttgaattaatatatttgaatatcatcttgattaactttaccagtgtgtttgtatagttattaattgtataacagactgaataagtagaacaaagttttttcaactaaggctatcttgtcattataatcattttatgaaatacatttatcatatatgtgtttatgtgcatttttaaagtatatcatgtaaatttaaaaaaatatttgtttctctgccctttttgagttactagttgggacagatgcttgtatcaaaaaatagattaacaagagaaaatcaaacaagtttattaaaatgtgtatatcatgcatacaagagagatgacccagataaattactatattgccagagtagatctcaaagaggtcactttgactttgggattaagtaccatcccttgctgaaacaaagaaagaagggtatgaggaaagggtaattattgggaaatagccaggaaaagtacagtgaaaaagaacaaagtctgttatgtggacttcaatcaatgccttccccactgataacacattttagagatgtagtcatccttctcttcctggagcagagagggagacacccttacaaatggatatttccttatagatgtaaacttctcttacaaaagggtaacttctactctgttttcaaagcttctcccttgtctgatgtttctcaaaatagtttgttccaaattatttatatatactaaagagacatatttggggtagcatattctggcctcctacagtcatattttggctggtgagtgataggcgtgagccctctcatttttccatttgaaaattctgccagaagtttcacagtccaggacatgagttggtggattatctcataatttgttgaagaggcatttctatggaaataaaagaaaaacaaatgttaatagttagagcaaagtaaaaaccaatttctgcatttggaggacagtcagttgaaaaaatttctagatgtgggttgggcttaaaacatcttttgcaatttaaatgtctcaatgttccagtgaactttctgaatgacctacatagctgtaaacaaaaacagaattaaactctgtaaaatatttaaagaggtttattctgagccaagtaagtgaccatggcccaaggcatagtctcaagaagttataaattggttttgtatgttttagggagacagaagacatcaatcaatatatatgaggtacacaagcgttcagtctgaaaaggtgggacaacttgaagagggggtgcttataagtcataggtggatacaaggattttctgactggcaattggttgaaagagttaagttattatctaaagacctgaaatcagtagaaaggagtgtctcagttaatataaggggttgtggagataaattgtagatgaagtctcataggtggccacctttagagataacagatggcaaatttttcctgtctgacctttaacaggtgctagactcttgctaatccattcaggataagaaaaggacttaaggcccagcaaggtggctcacgcctgtaatcccagcactctgggaggccgaggcgggtggatcatgaggtcaggagatcgagaccatcctggctaacatggtgaaacccagtctcaaaaaaaaaaaaaaaaaaaaagaaagaaagaaagaaaaataaaaggacctagaaaagggacgaggattctctacagaattttaatttccccattagaagacagaactgcaagactatttcaaaatatgtcaaagaaatatgttttggggtaaaacctcctacatgttatgtggtgctacactagagtcaggttggaatttggtatcctactgcaacaaagagtctgttttgtcagtcttaagatctctgttttaatgttaatgctggtcagttgtgcctgaacaccaaagggaggagagtacagtgaggcctgtctaaccctcacttcccatcatggcctgagctaacgtttcaggtttctttggaatccccttggttcataggggggttcattcagttagtaggaggacttagaattatatttttggtttacataacaatacattcaagtctatccacacatgagctgttgtagcgatttctctgaagtttttatcaatctcttcaccttcagcttgcagggcttcaggaaaaagacagttttgtttttagtgatttgaagtcagaagagtgagagcaaatgagaaatgctagtttggaaagtcatagtgagatattggagaaaaactggaagaattccgaatccagtttactttatggataggtaacagtagttcaaggacaatgaaaaggactagaatctaataggtatactataatttttctctctacattcacctccatttttaccaaaaataatcatagtaacattggtttctttgcaaattaaaagtagtctcactaaacttcgagtatttatataagtgagcaagagtagcaattgaacgtataggatctgttaaagtccactttgctggaacttatgagatatagcaaatacaagttttaaaccctcttaagtttagaaagccaagccaaggaattgacattggacttcatctacaatacttattgacagagcaggagcatcgccatcttggacaagcactgccattttaaagttcaccttgatcaaaaactgcccaaatccaaagggcatcagcctaatggctaaggtcagcctgaccataaacgacaaataacatctctgaccagaaacagtctaaccataagataaaccccttccccaaccagagacataccagctcccctctggccagagaaatgtcagccccaagataacctcccctccaaccggagacattccaaccccacagtaaacttctccctcacacagaaaatttctgagcctgtaataagctctctcaccctaaaaccaataaatactgtcagtttgtaagagagagtgctcatgacaaaaatcggccagaagcccctctcacgtttattctccaaaataaacatgtctttcactgttgagccatttttcatgtttctttcttctttctttaactcttacacctatagatatgggtaaattccttacctgaaagttactcaacaaatttactcaatttataaggccaggaaaactttttagccaggtgctagaccatgtttttcccccaagggtctctgttagctatataaagtcaaccttatttccttaaaactgtctgccccgtccctactgaaaatacaaaaaaaaattagtcaggcatggtggcacacgcttgtagtcccagctactctggaggctgaggcaggagaatcacttgaacccaggaggcggaggttgcagtgagctgagatcgtgccactgcactccagcctgggtgacagaagagactctgtccatctcaaaaaaaaaggaaaaataaataaataaataaaagctgtctgacaatatctgtttctatgtacattcctagtatgacattccatccaatccttggtaatgcaaccaatgttaccaattgtgtcctgttacaaagagaacagattattattgaactcatgcaaataaccatattgccatgaaaataaaagtattcactaagagtttctaaattctggatgaattgggtagtaaacaaatggtaaatgcttcaacaatcgtttttacaaatgtgtattttaccgtattgctccaagctgtagtttaaggaaaaagaaagggaaaaatgtttccttgaagccaaaaaataaaacattaagtaatcaacagtgtttgaaacaaaaaagcgacaaaaattacaatcatcctcatcagttatttcagtctcatataattaatttctgttgtgcttaatcttgggttagcaattttatgaatcctgcttttccatgagagttcaggaaattcttacctagttcaacgggatggttttaaagttatcagaaacatgtaattgttagtcttttccaagaatttccttaaagacaaagcacatttgtattatagttgctcacaaaatatttcaggaaagaatcagagaaaaatgattgtctgcagatggcaaaagattttacatggccattgttgaaggtctgatgaatgtacattataatgcaattgacactcatcagtataggaaatataggaatatggaacaaaactgatttttgtgtaaattcacattttattttatatccgtcaattccagcatcctttagtattagttctccatttatatattttcagtgctcaccctatttacttttaaaagtttctcattcctgagaagttcatcttgaatcaactcttaactgagtacattacctggccaaatcatttcttcaaaagggcacatagttctgtatttcccaagctgttctggttgagaaagttgtggttttcttgatgtaggcataatatgatactctgggatcacacattattttgtttttaatcaactttatattttataagattttcagatttgtggaaaaacttaaaatatattatggagaatttctaaatgcccctgcacacagtatcgtttatgattaacatagtatatgaatatggtgcacttgttaaaattactataaattgttggtacattagtataaagtagagtgcatacttattcagatttcagattttaacttaatgttcttgtcccagtccacgatgccttccaggataacacatagtatttattcatcttgtctgtaacggtgtcacagacattctttggttttgatgaccttaacatttgaggaatactgaccaggaattttgcttttattgttttattagaatttgttagatgtttttcttatgaatagataaacatattcttatgaaatgataaacattttctattcttatgaatagaaaaacataagatgtttttcttatgaatagattgagattatagatttttcttatgaatagattgagattataaatttcagagagcaagatcacagaggtaaattaccattttcatcccatcatctcaagcagacataccctgaacatgccccatcattgttgaggctcatgatgcatctctactgtcttatttcattgttcaaatgttctgactttggccattggttgtcctttcagatgggtcctttaacatccacctgtcaatgtgtgctttggttttgctgttgttgttactgtttttaagcacttccttacttcctggaaccacaaaatgctccaatttcatcttgcatatttcctgtcctctgaaatcagccatttctccaaggagtcattgttctttttacaggaaaatgggtataagcttcttgatcatttgctacttggtgttatttcattgtggctcactgacagagtaaagaacataaatgtatttattaccactgaactgtacactaaaagatggtaaagatgttaattacatatatacttatttatatctatctagatatattatctcaataaaaataaactctcctatatccttaaaaaaggaaatatatgtgtatatattcacatttttgcaaaaagcaacttatcaatgtttattttttttacttttaaaagtatttgtttgcttggaaatgttattttgagcctcagtgtattccttcagatgggcaagttctcctttcatttcattctgttttttattatttcatttgtgtgcttttattacattgaattaagaagtagatgagaaggtatctagaagataaagaacagcaaatgtttctctccaggcacccttggtctatgcaatcttacttatttcatgacacttcctagtccagtttcaggccagccgccctacctctcagaacatttgtcatttttctcactatcaccattgctaagctcaacagcagccaatcctgtatctgcccatatccacacactgccaatggtttcctactacactattttctcctcactaattaagaattaaatacattatttgctaggaccaatcagcaagtatatggtgttttgttttgtgtgctctaggtatgatgttagagccatgatcatgcaactgcactccagcctgtgagacagagtgagacacggtcttaagaaataaaaaggaaaaattattgtggtaacaaaaaagagcaactcctttgtaggaaatacaaacaaaagagggtatcttctttcttaggaaatacacacttaaaatttgaaagtaagctgcatatatcatgcaccaacctctctcatctcattatttctgtcattcatgtctgtttatccatccatccattcatttttatatatgcacagataaatgactaaattgagttcatcaataaaaatggcgacttctggacagaaataacaggtaatttaaaactttttctccaatggaatttacaaaaaccataagggcgtcattcttttttaaaatgtattatatccaacaataaaacaatatatttccaaaaaaaaaaaaacaaaggtgcttattaacgtgacaatgaacaatataattatagcaagtataaaacattttcctcagtaacttgagttatgttgttttctaagtaaatttgtttcatcaataacatgctactttatttctttttctatttcaatattatgttttcacaattgccattttgtttttacctcacacttgaacccttctattctaccatttattttattctaacattatatacacatgttttggcgttttttctcactatatgtataacttctctttttcctatatgaccattctgttctgttttctgttctatccatttttatgtgtgccttatgattgaggtgagggcagtagtgttcagagaatgggaaaatctgagcagaggagaccaacaaaaagcataccctctttgctagaatggcagatctttacttgccttctcatgatgtattctctaactgctttctactgctgtttgtttcaacctatgtgggggctgtatctgtcccaatgtgacaaacacctgggttttgaatgtgttttctttgcctgaagtcagtgtatgctacaagtgtgctctagtctgcagtcacttgtgccatttatgatccctgattcactcatttctccccaccagtcacttcgtttctacttctatccaaatggggaaacataatgatagtaaccacatttttctcttgatatttgtattaggaggaattccacaaattgttaccacatacctgtgtggcttcaccattgtgaaggaagaatgaagacctaagctgagccgggttgtcggcttcaacccaacattattgtcgttgttgttgtttcctcttccttaatagttttaaatgttaattgcactatgttaaaattctgttgtctgggttaaggttggggaatttgttgctgtgttttataaatttttgttaagttcataattggtgaagaaatactgcgatgcaggtttaacctgttatttcaatacagaaggcaccagaatatttttcaagccatacattgaggcttctgccccatgactcagctgaagcagctctgattgaggtcatcagtgccttcattaccagtcctgttgcttgttttagacctaattttaccatattgcactccagtacctagcatcattaatttctttttctgtctaaaaattattttttcctttcttatcaatggccttgttctctccttgccatgtgctgaccaacctgactgttactccagtcctatttgcttgtcttttttcctttgactcctaataaaatactgggttcccctagagaaccatccttatcctggctttctttctctccctgagctattacgtccatctgtatgttttcaacatctaactttttacttactgccccaaccataaatcaggttaagctctatctctcaaaatctaggcctactgaatacttactagtgaaacttaccaaaagctgtagttgtcatatttttcttccaatgttgttcttctcctagttcccttgtctttatgaataaaaacactcagatgagcagtctgaaagttaacgtcgttgccatctggcccttgattcctgagctttcatgcaaagttatgcaagtcactgactgcaaaacagcaccaggccaggggactgtctgaggctcaggtttcccaacaagcacaaaggtgccctggggtcaagcagcagaccatccccacttacaaaatgatgcccaaatcctttagcagtagcctgaattgcagttctgtggtcggttatctcctttctgcttcagtcatagtttaggagctcttcctcttatacccaacctgtcttcctgcttccacaattaccaccactggatccatcttccacattgtctgagcaatgattttaatccatactcctgagtaggctctctaccagttcacttgctccccaagaaccctcataactcatctatctcctcatggtagactctggtgacaacattccataccatgttttaaaaaaatactttatacaactttacttatgctcacggcattcccagtatttactgtgtcctttccacccctctgtgtccatccagctcatcatattgtgttttccaggctcattgcaaacgtcatctctatgaagcaattctgactttctgctattcctctgtttctcccttgctcccctccaaatatggcatttatattatagacctttggggactgtaagttatttacaaaaataccaggatgcactcacttattcatatttgtatttctagtattgagaaaaatgcctgctccatacattagtacaggggagaatggcattgattgaggaagcaattgttattagttctgaataagcacgcttaaaaaaataatttggtcttctcaaaaggattaagattgcacacatctacaactctcatattttttaaatacaaagatttccctccatatttttaattgttttacaaaaagagaaatacaactaacctactcaagtaacaaaaaaaaattaaatatttctaaatggcaggacgttgatttactggtctaattggtttatttgttctagagaatgtgtaatgtaatgtaaattatttccctgtaggtaaagacatctactatattgagaaattccacctattttatactgcctgtgagagcagaaatagcctttgcttgtcattttttaaatttactgacaaacccagcactctactcttgccgacattagatgaacaatgaattaaacagcttacttttgacaactcaactctctgaggacatgcagactcagaaacatcaaagatttcatgggatcagttttgtgtgtagagctatgaaatgtgttgattaaggtcatctggaaaaaaaaaggataggataaacagaatgatttttagttatatgattaaaggatgttgacatgtgaggctatttttgtcatttcagaggttaatgtacttaaagctttattcttactccacctaggaattgcatgttataggttgctagcattaattttcagtgtctcttctccttaaaataaacactacaattttatccttttcttggtgaaggcacagagctgtgtcctaaggttaaatgtgtttactaggaaaaatattaattccaaaaatattatttccaaatattagttccatttagttccaacatgtgaccagtttaaccaagaggaatttgattctgttgcaacatgttttacattttgctttgcaaagttcctctaagaggagcaaaatggtaatgttcaacctttagacttaagataaatagtatataataagcctgggtagaagactactatataaatatttcaatccttggttgtatgcggtatggaaaacacagtaacataaaattcactaatctgctatgtaatgtttatgtggatccagatgaagctgtgtcttcactagataatttatcaagtttactgatcttacagtatcatttactaagttatcaccgaatagaatgcacagacttaggacaaatctccagggtgcaactgcatcagtgcccatgattcttttgtagcacaatcatgcataacagcctcagaaagtggaagcgtggggtcagtgactgaagttgtacttcctcttgcttataccttagttatagtgagacagtgctgtgcaccattaaagagtttgcacacatcattgtatcactaacaccattgaagttcttgcatttttaattattcatacttaaagaaatattacagaatcctgagccgtttccacaaatgtagaagctagaatgtaaatgacactggactggaaattttgtctgttttgcgctttgctgtattcccagtgcctacaataaggactgatatcataaatgaacaaataataaatgtattattatttatgctcagcaaacagttttgaaatgaatattgaaagagaggagaagtcagatgtgtttgctggtggttacagtcaggattggtaccaggaaaaactgcagagttgcttaaggtcctccaccttcctttgggatgtctgtttttccccttttatagcaagggaatgcacggaatgtacacatagtaggctttggattccgcagaatgtcatcacagaatttgattgggcatctgttgaagaacatgaggaatgggttcctactgagtattgcaggggataggggtacaattacgttattttcaacttgaaggattcttcagttccttcagtgccagcaggattcctggatgactgctatccagttttatcttccaggaaccatagctctctatcccacacagggctggggtctctttcagaaacattccttcagcctcatgtttctcagaccctcttctgtacctaggttcctccaaatcctgcctattttaggtatctggagttaatgtaaaaaacaagccacttgatgtgcttcgtgagtcattacattatttctccctaagatactcaatacaactctataaaaaatggcttagctacaatttcagaatgccatttgcaatgcctaaaggtccttgaaagaggattctttcttctttttaatctcaagaatcgtagggtgaataatgccatttttcactgctgtgttctctacagaatgtgaggcctttgccgggaaacatcactgtttaggttcctggggtttaaggaaagtccagtctttggcaaatacctaatacttttagtttgcagtttccgaagagttttaggtttttccagttgtaatatccttgattcctaaatatagtcattagtatagcacatatattactttattgtccttatttatttacatttgcttattcctattcattcttcttgaggacaaaatctagtcagttatcatattaataataactgtactcatttaaacatttttaaattttttgggatttatttattttgttttgttttgctttttttgagacagggtctctgtttgtcccccaggctggagtgcaatggcgtgatctcagggctcactgcagccttgacttcccaggttcaagcaattctgcttcagccccccaagtagctgggactacaagtgcacactaacacacctggctaattttggtattctttataaagatgaggttttgccatgttacccaggctggtctcgatctcctgaactcaagcgatgcctatctcggcctcccaaagtgctgggactgcagacattgaccaccctatacatttatgtatttattcattcttgcatatgtggatttcattaaagtaataatcagtgagcatttgcagtgcaatcttgtcggccttgaagtttcagcagagaacaaaagacataaggtctctcctcaaacatcttgcctattcgaaagagacagacttatgtgtttatatataagagagagagacagacatatgtgtgtgtgtgtgtgtgtgtgtgtgtagaatgcaatgtcagataatgaaaaggactgtgaagaaaaacaaaacagggtagaaggaaagagtgtgaggtactatttttttaaagagtgatagggaaaacttctccaaggagggttatttgagcaaagacctgaatcaagtggggtaactattctgggaaaaactttttcaggtggaggaaaaagcttgtgcacgtgccatgtaatggaaaccttcatagtgtgtttgaaggccagtgacataataaatgagacagccaggtaagaaatgacctcaggaaagttgcagggctagatcgaggaagactttctaggatgtactagggatttggaattttattgtttgtatgatagagaatcaatgcaggctttgaaaaggagtaatatgataaaatgactgtctttaaaaaattactctggcaactgagtgaagaataggctacaagaaagaaaatgagatcgtagagaccaattggaggggtgacatagcaatctgactgttgcttgtgtcctagaccaaggtgtcatgaataaagctaagtagaaggcatagttaggatacaattttaagacagaaaagaccggacatgttgatggatctgatctatgtgagagaaagggagacatcaagatgctctccgttgttttggagtgtccaatggtagaggcatttattgaaatggagggaagttcatggtaggaagcagaatgaggaaaggtgtgtgtgtgtgtgtgtgctctaatgtttggtttgaaatgtctatgacacatacatgtataatgaagtagtcagtgggtttgaatctggaattcagggaataggttaatcctacagctgaaaatacggtatccatcagtatatagagacagcatttaaaaccatggggctggatgacatgtcagagagtcatgtggacagaagtgcagagggaggaaacaagccagatgagtaaggaagacagggtgttccaggttggtgcaacatttaactgtagttgagagcataatctacttgaatccaggacaggtcagtttgggtaagatatggaaagaatgaagggtgtaatgtggtatgagccaaaaggagaaaccaggcaatatgttagaaaatggatggtcaatgatgctgcggtcctgaggaacaactgaaggattttcaactgggaaattactgacatattcagttattttttttaaatctctctgattgaagtgtgaagactggttcagaaaggaaaagaggagaggcagatagactgttcagaatacttatagaaatacctgtgagggatgactgtgtctggcgcccagatggtcactatggaaagagacaagcaaaggcatgtgaaagacaatgagaagatgtgggttaggtttctaggttgagtgcttggaagaggtattactgtcagttgagatgaagatgaccagggcatgggagaggctccgtgagtttaatgtgctccttgtgaaaggaatgttttgatatttggcaacagaactgggatgtatattttaatatttagttatccataacctacaggtggcatttaaaactaaaataatgaatgagctctctctgtaagtttataacataagaagagggagcaaggggcacctgaggaaaagcagtatgcaacagcattgaaggagaccctagcagaggaggtggagaaggaggatccaaggacctgagggaagacacagtgggttctggccttggaagtcaactaaaaagtgagagcttcatcacaggacccctcaggagggtccagaattgtgttcatacaaagtgtttccttggaacaacctgcgtgtagcctttggaattcattatagaattgggacatccaggttgtcttgtcacgtgattgtctgctagggttatcatagccgagtactaaacactgattggtttaaacaacagaaatttgtgtccctgtgattctgaaggctagaagtccaagaccaaagtgttggcagggttggttcctcctgaggcctctctccttgcttgaagattgtcatctcctacctatgtcttcacatggttttccttctacgtgtctgtgtcctaatctcttcttatatagaaccagtcatattggattagggcccaccttagtaggcttctttttttttttttctttttttttttagactgagtcttgctctgccacccaggctggagtgcagtggcatgatctcagctcactgcaacctctgcctcctgggttcaagagattctcatgcctcagcctcccgagtggctgggattacaggcatgcaccaaaacgcccagctaatttttgtaattttagtagagatggggtttcaccattttggtcagtttggtcttgaactcctgacctgaagcgatccacctgcctcggcctcccaaagtgctgggattacaggcgtgagccactgtgccctgcagtaagctccttttaacttaattacctctttaaagaccttatctccaaacacagtcatatctgtagtacaggggttaagatttcagtatataaaactgtgtagtatacaattcagcccatagcacttagaccacacaaatcctacatttatgggagctgtgacttgaaaaaaaataaaaatatcttcagaaataattcaatatttgacatcatataacttttgctatctctagagaaaaacaatttatgctgtgacattactggaaagaacgtcttatcaagaaaaaattatgacctaaacaatgatgataaattaatttacgatctgttattaggaaatgtggaagattgaatcaagttgtgcaaataggtacacatgtctactttctcttctatcaaaactgtagaaaataataaaataaaaataatcaaataaatacacagaataaaaaagttaagataacctaatattattacacttaagattaagtaattcctaaaactgcgacaagtaaaaatgtcaaatagaccagtaagaacctctatatcaatttaattctgaatgtgtagttctaatccacattaaatagctacaagaagcaaaaaaggctcaggagtcatccaacagcttcaaagtattcttaagctttctatgccttttaaagagaaacagaactataggacatgtgtatatattaagagagatctattttaaggaattggttcatataattatggatactggcaagccccaaaatttgcagttgaagttcaaagaccatcaggctagagacctgggaaacagctgatgttgcacttcaagttcaaaggttgcatgctggcagaattcctatttatgaggcaggaggaaaagaaggagtcagtctttagttctttagttctagtgaggccttcaacagattgagtgaggcccacccatgttatggcaaatctgctttccccagagtccacagatttaaaagttagtctcatcaaaaacacttgcataaaaatattcaaaattacattccaccaagtatctgagagccatggctcagccaaattgacaataaaattaagcatcataatactctacttctcctctacattttcttatcagtgccagcaggaaaaattagtaaggaggtcagtggagcagatgtgcaggtgagtggttcagatggccactgtcctgccaatggctcaccagagccggacaacgagcactaaaaaaactccatccaacaccacatcacatctctctctcagtcaacagatacaggctgaagtcaccagatcagttaggtaagtagaatattcaacagacaaaccactttgtacatagtatatacctatggaggtactgtagtctgagaaggaaacaatttaagacaatacctacctccaagacattttgcaaatttagggaagaaacaaagaaattaaaatcaaacctaaggacaaagtacattcttaaggatacgttttaaacaagaaataataatcatgttttctaataatgataatccaggtcactgtaaacagatagaactacaaataatggcaacgttgataggaggttgaacatagaaaatgcttttggttgccaaactccatcatctcaaacattcataatacttctatatctctacttattccagaaaaatccatatatgtctttaatcattttgaagtttaccttaaaggatatttttctcctttaaaaagataggtaaattatttctttgaaatacgattttttatccaaacagagcagtgtttcattgaacatattgcagctgctttgatttagtagtgagtttccagttgccatcacagatatgttgactggagtcacctgcattgtcaagtcatagtttcttctttgtgccataagttaaaaagagatagacatgactgccaaaggttgtttgcatgtaaacaaacaaccttccagaaatttaactattctcattgttttagttgttctttaactgccagagtcagcatttgcttggctattcaaatgacaatttaaggacaatttggaatctgccaagagtttgccaagatacatatgatgtgtactgaacatatcatgcatagaaaataaagtgctaaagacaaggatatctttggacaaaatgttcctcatttgagcctaatttcattctagaggcttcaacacctaatgattgataacaaaactcttaatgtaaaaaagtgcacctaaagcatttaaatcctatgatggcatttgagtgtgtgcatagctcattaatgtgatgctaggctgggactctatgttaaagtgtttaggaagatttttagattttaaaatatttaatattcaatttgtctttcagtagaccactcacagctccccaggagagatggagaacaccatgttctgcattttaatgagaaacactaggtaatggaaagactgtgttgcaggctacaattgaaaaaacaaaacagtgaaagacagtgtggtgattcctcaaggatatagaaccagaaatactatttgacccagcaatcccattactgggaatatacccaaaggaatataaattattctactataaagacacatgcacatatacttttattgcagcacaatttacaattgcaaagacttggaaccaacccaaatgcccattaatgatagactgtataaagaaaatgtggcacatatacaccatggaatactatgcagccataagaaagaatgagttcatgtcctttgcaatgacatggatgaagctggagaccatcattctcagcaagctaacacagaaactgaaaactaaacacctcatgttctcacccataagtgggagttgaaaatgaaaacacagggacacagggagggaacaacacacactggggcctgtcaggaggatggagggcaaggggagggaaagcattaggacaaatacctaatgtatgcagggcttaaaacctagatgacaagttgataagtgcagcgaaccaccatggcacatgtaaacctatgtaacaaacctgaatgttctgcacatgtatcccagaatttaagtaaaataaaaaataaaaagacagagaaagagaaagaaaaagcaaaacgaaaacaaaaaacagtttattccatgggcattacatcacatttgaggaaattagttatcctgcttattaagtagtaagcgcaagaagtactccctaaatatttgtcccacatagctcataaatccatctggagatttgttgttcatcagttcaactctagatttcttaaaaatggggtccaccttatccatccctaaatttgtagtttttggcacagattagaatacatggcagtgcccggtatattttcatggtctttaatttcatggacgtaaatattttgtggaattaattatttttcgaatgggaaacatttgaccaatgagtcatgattgcacatgacagtatggttgtcctccttatctgcagaagatacgttttacaaaccctagtggatgccagaaagcatagatagtatcaaatcccaaatatgttatgatttttcttatacatgcatgcctgtgatacaagttaaattaggcagaataagagattaccaacaatcataataaagtaggacaattataacaacatactatttacaatttcacagatagatggctcattcctaccatagatcttagcaaccccagcacacaattttttttcttttccttattgagtcaagaagtcacaacttttcacttggaagcactttatgggttgtctttggcatatctggcctctctacttttgcactttggggcattacacagtaaaataagggtgacttggacacaagcaatgtgatacttcaacagtccagatggcccctaagtgcctcagaggtggggaggctacacagtgtggagacgctggagaaaaggagtgttcacatcctgggcagaacagttggagattttgttatgctactcagaatggcatgcaacctaaaacctattcactgttatttctggagttttccattgaatattttcagattgtagttactgcaggtatctgaaaccaggaaaagcaaaaccagagagaagaggggattattgtggtgtggtagcaagagaactgagttgcaggaggaagatttggttgaaatatgtggcttttttttttttttacaacaatttggttcgtttatgaggacactattacatagagaaaaatagaagtaaaatattgtttttgttgtcaaaaacagggtaatgggggaaggaagaagacagaaacacattatgtcacaatcctgttgaaaagctaaaaaaaaaaatccatattaagggccgaatcatcttgtcactggccagctttacacctgctcatccctctccgcaagataaaggcctgatccaacggcaatgaaacttttcttatctcccagagatggacaaatgatcacatctcagattagatcctaggttttgtctccaaatatcaggaagagtagagtagttatctgcctaagtatttatatttcaagaagtaataatacctggaaatttggaaacatctctaggttggaaagattcagatacatgagactatttggcttctggagagtatatttatattccaatggggtggagttagggctcagattcatgatgtttccaaagatgcactctcaagaagagtgagggaagctgccttattccctttgtaagcagagaaaactcattttcttcaccccctgcccatgcaatgtacagctagttatgttggaaaaatttccctcagctctcatggcataagataaggatgaaggcaaggggctgatgcacttattatttactttgaagtaataagtggtctgtctctgatccagaacacttcatgtgtgcaatcaagatacatttaataaagatgaatattaaaaacctaacaagcttcaattcaattttattaccctttggatcagagaaacagaacaaatggccatagatctactccttattgtatgtgaagagtgaaatgtttctagaggaagtgacggcaaacatttcctatttttgtgctgtatacacttctgtgtttcaggctagggtttctagcatgagctctgagaaatacaagcaagtttacttcatggacactttattctttggttggtatttcatattccttcaaaattgatcttgtagcaacaaaatcaaccataagaaataataggaaggtttaattttttataaagtattgaagttcacgttgtttttaaatgcctttgtttgaaagtgaaatacatatattgaacttgaacactcaaaattcccatggaaacaaatcaaataaagtaattacaaagtaattgctaatgttaagtatgatcaaatttaagttgtctcttctaggaccagtttacaccttgatagttttagcatggcaggtgtagatttaagggtaccatgagaaagagaaataccaaaagttttccgaagagacagggttttgttggtcaaccaggctggaatgcagtgatgtgatcatagctcactgcagccttgaactcttggactcaaaataccctcctgtctcctctttctccttcttcaacttcaccttctcttcctcctcattattgttattgttgccattgttttagtgaaaaagaaagaagggggaaaaagacatcatatattgaacatgtatcataagaggggcattcaagtaaactctttggaatcttacaaagttttcaaatagtcttttggggaacaaagagacatcatagggtaatggaatcctaagttagtgccaaattgaaatatttgagtcacatgtgcaactttaagttttctaggaatcacattaaaaaagtaaaagaaattgatcaaattaattataatagtgttttaatttaactaaattgatccaaaatattgaaatttcagcttataatcaatatgaacattattagagagggattttacatttttgtactaaaccttgtctgtaccatatttatttttattgggatctccgttagaactagccctatttcaagggctcagtagatacgtgtcactaggagttgccatataggacagaataggcctatggagtaagatcttacgtctacaaccaacttgcctgttctttaacccatttactaaactttggtgatattacctaaatgctttcaactttatctttcatagcagtatctgatatagggtagttgtaaagactaaattaattcatatagaacagttagaccaaagcctgtcacatattttcaattattatagcacttataattgctgaataaatttatttttaaaacactttttttgagattagttttagtatctcattcacaaaagaggaactaaatgcagagaagtccaataatctgcccaagtttgctcagttagtagctaacttttgtcaaatttattgtaattttccctaatgcacttatcttttcgaccaaaagagtattacgaaacagttgtagtatgcaagcaccagtttgtatacttatttgtttgcatccttcatgaagacttttgttagttgttaattaaacacatgcacatacatatctacatagtatacatttttgtgtgtgtgaatacacaaattcgtttgattcatgttggactgtcccagagtcctggaagagggtttcctgaaaaacatatcttaaatctgtgcccagccaataagttttcaagattattcttggtttttctttgcagcatcaaaatataagaatgggaaaaaaagtatttcaaagtacttaagttaaaattggtattcttctaataaatttcaatagtttgaaatttcttcttttagtgatagattaagtaaagcaaataaatttttcccatggaagaaaaaattaaaaaacaggagactgattaaaaaaattctgatataatttttatcagtattcattgtttctctgtgtggattcaagttaccatctggtaccatttccttttagcctgaagtaattattttagcattggttgtaaagcaggtgctagcaacaaattttatctttctttatcttggaatgtatttaatttgcctgtattctgaaagatagttttgttagatatagacttttcagttgacgtttttattttcttttaacactttaaaaacatccttctgctgccttctgacttcattttagtaatgagtagtaagagagctatattgtggtccccttgactagaaggagtaatttttgccttgctgcttataggatgtttcctttgtctttttcaatagtttgaaaagcctgtgtagaattatctaggtgtgtgtttttgtatgtgcttatcctatttggagtttatggagctacctagatgtacaggataatatttttcatcaactgtggaaagtttttattcattatttttccattttcttccttcatcactctctcctgcctctgcatctcagactcacattacactcatgtcattatgcttgatggtgttctaatggactatggggcgctttatttttctttttacattgtgtgctttcaactgagtgatctttactgatttaactttaggttcactgattctctattctagcagctcatatatactataaccctatagcaaaaaatgttatttcaatatcatatttttgaattccagaatttcaacttcttttttatatgatgtctatctctttattgacattctatatttcataatttatcatcatcatactgtcatttaattctttaaaaatggtttattttagttcttcaaatatacttacaataattgatttggagtctttgtctagtaagttcaacagctgtaaattctcaggaacattgattactgacacctttctatttttaagcttatcttatttttttctggaaactggatattttatatactgttttatataatatattgttgcaattttagattctcacatcccctgggattgccatttttgttgtttttctgttcatttattttggtcattcatttttacataatttgtctatactagttctctagagctggtctgccctgaaacatgtatttattgaagtttctgctctgttttgtttttgtttttgttttctgtttttgttttttgttttttttttttgagacagagtctcgctctgttgcccaggctggagtgcagtggctcaatctcagttcactgcaacctccgcctcctggcttcaagccattctcctgcctcagcctcctaaatagctgggattacaaatgcctgccaccacgcccagctactttttgtacttttggtagagacagagtttcaccatgttggtcaggctggtctgctttttttattattcttattttttaagcatgctttccagggattacctgcttaaacatatattgagtgacactttgctgacagaccggtgtgtggattggggaacacatttaatgtggaagcagtttataggtctatccagcttttaatttctgcatgtgtaaggcatcctgccccactaagggttcagttagctgggccctttcctgttgcctattaggtgtgcagacttccagacaaccaacagcgttgtttcatcaatgttgtgacatcagctgtgatgtgtttccccgattatttgccactgggatcactataattttgacaatgctctggttaaaggtttttttttcatacttcactcagaatcaagactgccaccttctgtagtgagtctgccagtatccatgatcatccctccctggttaaactaccaagcaaaacaccataaactccaaatgttcttactgagatttagtgaattttcttgaataaatgacttttagtttattaatggatttaatttaaaaaggaatgaattactgtcattttaatgggagtatgttacatatcttgggtgtgaactcctgagaagcgattaagttttgcctccattttctctctgtctttcatactctcataaatgatgcctttcagcatgttataacataacacgggggccctcaccaaatgctgagcagatacaagcactctgcccttggatttccagtctccacagctgtgagccaaagaaacttcttttctttataaatcaccctatatgcttttggtcaatttctagtgttctgaaataattgcttttgacgattgtgtccagttttatcattgctgctgtagaaaagctttgctgagatgcttacttagcatttccagaataatgaatacaagtttgatggataaaataactaatgaatgtattcatatcaaaccatatgccaaaatgtcttaaaatttctcattttaaaaaacatttaaattaattatatagtaagcacataaacacatatttatgttactactttgaaaatctgtaaatacgttagtagcatttctatggtctctaagacgaggacttttttcacaatggactccctgattatttattaagttagttaattagatattaacctccttgattcaaatagttcttgtttataaaagtgactgacttttaatcacaacattaaattagtttctgagagtaagggtgtttttaaattatgattttagaatgtcctcagtacatatagcaaaattaatatgctaaaatttctcaatttattatttgaatgttagatagtaaataaaggtaataaatatattttatgacatattcatagatacttaatatacaatggaatatgcttaaaaataatataaaacttatgattaggcctcaaattattttgcattggaatacataaaaataaaactacctaacctatataatatgtataatttcatagaacatattacatcttctagaaataagaaatatgtatttgtagcattttcaaatagtaggtgaatttacaatgcatatgctttggtcttctgcaaaagtctttttggtcttttgtttttattattaaatatataatttttaaaaaacgatttgtatgtcttaatgttttagcttgtgagattcattttatgcctgattgtagaccctagaacatcctcttctgtgagctggacatggcaaatgtagtcatttcagagtcaagaattacaatttcaatattaacaactccatttgatgtttttattttattttttaactttaaaaaagaatcatattgaattgccaagctgctttcttctatttctgctacgtacagtagaatgctgcaaatcacacaatagttatgccaaaacagatatgtttgcactttgctttaaaatcccacactggctctgtgctattgtttcaatgtccactccaaaactcatgttgaaatttaattaccatatgatggaattaagaggtggggcctttaagaggcgattagaccctgagggttgtgccctcatgaatggattgatgtcattatcatgggagtgtgttgcatatcttgggtgtgagttccggagaagagaataggttttgcctctattttctgtctgtctctcccactttcatcatgtgatgccttggccctcaccaaatgctgagcatatgacagcactctgaccttggacttcccagcctccagagctgtgagccaaacaaacttcttttctttataaatcaccctgtttgtagcattctgttatagaagtagaaaatggacaaagacatctaatctccaccatgacattacagcttcttttgaattaataattttttggattaactataatactgcacattgtatcaactgatttttttctgtagttaaatagactgacacattaaaacaaagatagaaaagttaaaactaaagtggaggcaaagatatgacaggcaataccaaatagaaagaaagcaggggtcacaaacatgatatttgacaaaatacattacagaacaaaaaaaagtatttaaaaaaaactaaaaagtttattttatcctgctcccacccacttctagttcttgacttatatctttattgtctgagcagatagctttttcatactatactctgtctaatatagccatcatttcatgatgatccaccatcggatagaatttgtgtgaccactatttcttatgtcgcaatctctcttgtcattttggttatttgaaccttattctctgttagattcctcgagttgctcacaggaacttttatttttattttttatttcttttgtttttgagatggagactcactctctttttgcccatgctggagtgcaatggcatgatctcggctcactgcaacctccacctcccaggttcaagcgattctcctacctcagcctcccaggtagctgggattacaggtgcggaccactacagctggctaatttttgtattttttggagatggggtttcaccatgttggccaggctggtctcaaactcctgacctcaggtgctcacaggaacattttattgagctcttgtatgttgaaaggagttggtcatagtctttatatttctcacattgtctttttattagtatcttaagtatattactgcattttctcttggcataaactatagcaatgaaaaaaatctaaggacagtctaattttctttctcttatggtgtacctgctcaatttttgctcgggtgataaaacagtttttttaatgtttgtttttaaagtctggtattttttactagaatgtgtcttcttggtgttggtcatttggatttggtttttccaggtttgatgtattattcaaatacaaattttaagttttgtttacattttaatttgtggaaagttctgtggatgtttggtttgtttgtgcttatgtgtgtgtgtgtgtgtgtgtgtgtgtgtgtctgtatgtcttccattccattattttcccattattttggtttttactttgtttttgtattttttccaatgtggaatttcactatatatgtgttagatcactttgtctgttactttttttaataatacctttttatttagtttatctaaaaaattgatgtaagtaaaacatataaaccaaaaattactcataataaagtttaaggttcaatgaattggatgttgaataagtaatatctggattaagaaatctaaatttcagagtctcagtaacccagtagctccaatttacatttatccaatcaccaacattgccaaaagttatacagcatcctgtgttatatttatttaaaaaaaaaaaaactgtttcaatagctttgggggtacaaagggttttcggttacatggataaattttgtaatgaattctgtgattttagtgtacccatagtatacattttatccaatatataattttttatccctacccccctcccaccctcccccttctgagtctctaaagtccattgtatcactttgtatgcctttgtgtacccataggttagctctcacttataagtaagaatatacagtatttgattttccatttttgaatactttccttagaataatggcctccagcttcatccaagttgctgcaaaggacgttatttcattccattttattactgagtagtattctgtggtatatatataccacattttctttattcattcattgattgatggacactggggttggttctatatctttgaaattgtaaactgggctgcaataaacatatgtgtgcatgtgtctttttcatataataactcctttttctttgggtagatagccaagtagcaagattactggattaaatggtagatctacttttagttatttaaataatttccatactattttccatagaggttgtactaatttacactctcaaaagcagtgtataagtgttccttttttaccacatccacaccaacatctattgctttttgactttttcatattagccattctggtacgagtaaggtggtatctcattgtggttttaatttgcatttccctgatgattagtgatgttggccattttttcttgtttgttagccatttttatatcttttttgagaaatgtctatttatgtcatttgcctactttttgatggatttttttttctgatttctttgagttccatgtagatttcagatactagtcctttgttggatgcatagtttgcaaatattatctcccattctgtgggttatctctttattcttatgattatttcttttgccatgcggaagctttctaatgtaatgaaatcacatttactttttttttgtatttacttttgaggttttaaaattatatctgtttttaaattttacataagggatatttacagtatgtgctcttttgtgtctggtctcattctctcaacatcatgtatatgagctcatcaatattcctgtatatagttattcattacttttcatttatatatggtgtttctttgactgaatataccatgatttaattctttgttgttccgctaattaaaatttgaactttttaaagctcttggctattatgaatagttctgacgaccaaggtgtcaatctcttgattaacctatatatgcattctcttgtacataaatgtatgcaggagactaatgggtcttaggatatgaatatgtccaattttagctactgccatttttccaaagtgattgtacctagggttatatgagatatttaagcactgttcaacacaattagaattgtatatatttcattattattattatttagctgattggactatatgtagtggtattgcattataattttaattcatattttctccatttattttttatttcaaaaaaatttcctctcttccatctttctgtttcaaggaattttctatttttttattttcctcttagcctttatgtctgaaaaaagtattttatttatgaaataaaaaatattcctgtgttttattacttgatttttgtttttaatcctaatttatatcttcattttacttttcatcatcttcttagctcattttgaaacattaggtcataattttcatcaatttatgggcatgtcctatgctaatgttgcctctaagtacattattctgtcttcgatgtttttcttgtatcagctttatatgtaattcaattataacttctttctgttcttcatttttgtagacatcatttatttatagctgaacttttaggaaagaggttacaaaaggcttgtttttctagcttcatggcattagagatctttctgttgccctgtgaattgttttaaaaggcactgtcccacattctgagatgtcctggatctgttctaacatttcagctttccctttgcccatatttttcttactccttcaatgaaaatatatgttgctagaggtttctctcagctcagggctttgttctgaagaaagctttgactggacagtaagttcactcactccagtgatgctgcaattgcttccattgtctgttttgttttatcgttgtcctgcaaggaatctttggaagcgctcacaggactcagatggtcccagcaccttcagactttatcagagacccctttcactctggtattaatttgaaacaaaaacacttcaagtttcatcttttgttctcaaatcagtccattgtacactccagagagttcctattagtgggattagtttttctttatttagttcttccatagtcgtgagaggcttctctgcttctctctgcttcctccactcagacgctaatgccatgcaaggcctatagagttcacttgtattttcttcttgaccaagcaagcacattggggtgtgtatagctatcttacctccttttgtgtggtcattgttgtagatgttgcccatattttaatattttatgtataaaccactcttctcattttcagagggatttaagaatgttaaaaaatctacattgtcaccacctccatcttccttctgttttcttttaagatttgtaatattccaagttatattaaatatatagtcagctgggtagagcacactaccattaatttaatgtcattgtttctaatggattatatgtcatacctactcatttatgtgttattaaatgcttaataaaataaaagttgctatcatttcccaattgtccatagatattggtgtcttctaacaactggctcttaaagtcagaaacgctatttagacatttttgttcttgctaactttctgccctcgttttcctggcaaatgatttccagagctagatagttatacaaatgatgttttgtttttttttaaatgtttctattcataaactagatttttgtgtgttataactaggaagcaatagttttgatctacacatcaaagatgactttgaaaggctttcctgatagaacacaaatgtgtcttcccaaattctaggcatttatagtcatctggaaagagctaatacttagaagaaataaaaaaaaaattttctaaagctattttacaacattcatagccctttactgaatttaatcaagcttaaagttcagaagatgaagaaagccacaagcttttggttattgttatatatttgaaagggcacctaggtttaagtttctttcgaaatctgtgtatcattttctaaagcaaaaatgacaggatttcatgataagagggaagccgcgtatttactcttttctctcaggtttttgagttcctaaatattaaatagactttgcctctttcttttttaagacaaaaaaaaaaaaatcactgttctgtaaaaatgtactgattatttcaagaagagaaagtcagatggttttgattccttcggcccacatagttaaatgcaaagctaatgctgggaaaacaaatgaatttcgtatcagatgttattttactgtgctcatacttcaacgagatgagtgggggattttgacatgcaagctgcattcattaatttagggcaaattgattgtatctttcttggtaataaaacttcaaaaagctacagaagaggcaggtaacattgagggctggaacaaatataccatatcttagtagcggtttaggtatgcagctattttaaagaagagtgacattggcttctgagagacgaagtggagattaaaggaaaatgtgtatctaatttagctttaaccagttatcttccaaaagtttttaagaccttagaagctaagaattttaatacttagtatcaaaaaaaacctttttattgcaacaacaaattaattcgctgtccgcaaactccattggtcagtgtccaaaaaatattggactgagacaattaactggaaaacattgtgttttaacttctgtggtattaatatcaaaagtaaaaaaattcagtgtctatgtgcgtaaaaatagtcaaacagcccattttatttaatcaatattaattgaaactcaatctgtgtttgagcacatccacttgcatatgcatctatctagaagatcctcgtacatctaagcttacagtttaaaatgaccattgtccttcaagttggtcgcctggggaaggagtttacctactcgaaccatgtggcattgtttgaaatatctgctttgttttatctcaaacttgttacctggattattctctagttttattaaataaaataattattgattccttggagtgttataaaatttcaatttcaaagaataaagattttaattgctaacaaaaattgcagaaatgcatcctgaatgcagttctaagagtagaatttcaagaagcttaaacagtcgcaattttatttaatataagtatcctggctgggcttggtggctcacgcatgtaatcccagcactttgggaggtcaaggtggatgggtcacctgaggtcagaagttcaagaccagtctgaccaacatggagaaaccctgtctctactaaaaatacaaaattagccaggtgtggtggcgcatgcctgtaatcccagccactcgggaggctgaggcaggagaatcgcttgaacctgggaggcagaggttgcaatgagccgagaccatgccattgcactccaacctggacaacaagagtgaaactccatcccaaaatgagtaagtaaacaaataaataaataaataaatgtaagtatcctttgaaagtgagtctgtgaagctattaaagtgtttttacataagatttgatatattggttaaacaattagtattgtgagataagatatacataccagtataaaatacacatttcccatatataaagaatgtatgtgtataattgaatcatgaaatgtcatagctaaatggggtcttacagttaatctatttcagcgttcaattgccacctcctgcctttagacaaatgaggacaaaagtccagaaaattttatttcaagatcacacagctacttaaggcctgagccaaaattaggtcctgacttctgattcattgcttatttcactgaggcatgattctttctaaaaatattatgagccttcctatcaacttaaaattactgtttttaagttctgtttttgaaaatgtatttctttcattttatacttggctatctaaggtttgtgttccctctgtgtgttctccatcatcccattcatctcacatagttaagggactgtggctgcagccaagcctgaataattggatacctctgtcagcattcattatcagggcctgcagaacccacacagtgtgccactttaggaaaggttatgttccgttgtagacagcaatatgtgtgctgatcaaccaccaacttcacattttaaatgcagagcctaagtgcttttataatcatgttttgatgaggtgtgtgtttatgtatggcttttgacagaaagccttttcttaacaggatcccttgagtggatacattgagtaggttgtgtgcctagggttacgaatcatcttttacatacaaacgtcttattcttaaaatatgtatttttgatatgcataatgtgactgaaaatataaatgctttgggcctatgtaccttgaaattctgaaaatatatttcaaaatcttaaattgttatccactacaacttgttcaattctctttatatgtatatttcttatgaactcaacaaagaaaacacttaagaatgtaggtaagcgttggaaaactctatatcttgagattattctcaaaaatattctgtagaaaatacatggaaatacactttgtatagtttttgactgacccaagagtaatgtgaaatattcaattaagttgccagggtaaccaagtactagtctttgcatttaatttctctagttcagttatttgatatttgtgcattgtctgttctcctgggatcactgcagactcttaattatccccattaatggagaggactggaagaatagattctccttaataacagtaaagaaaggtagtatgcatatgattttggaatgtattttgtgaagaatatgtttttgtatgtttttaaaatagaaaaaaatccagctgtatgacaatggacaagttacatagtctgctctgggtttcactgtgggttcagtgttcctattttgaaaatataaaaatttaatagtaaatccaaagctattagagtgaatattatctgggatttcagtgatattgtaaaatattaaaccaacaaatgcttttagttccccccatctatcttttctggtcaattccccgctagtcttatttccaaggagagggatgcttagtgattgtctcaaaataacacagatagatggccccaacgaaagatagcttatttctccaataatcttgatatgaaattttggtataattttttaaaattctagataaaacataatatttttatgcataatgaattcagaaatatgtaaggtgagtaacagagtaaaattgaaaatccaagcagtagctgtaagctggcacttcagctgcctcaaggaggaaagagattgtggaaaaagtcagtctttcactcagtagccaagggtttgggttaaaaagttctacgattatgaaaaatttcaagcctatacaaaaacaatgaaaatagcataataggccacctcatacccattactaaacttccacatggcaaaatatgttcatctctacgttttctcaattcctaacatgccttccaggattattgtgaaacaaaaaccagggaacaatacaatttcaactataaggttcttcactgggcgtatgttaactatgagggctttaaaacataaatataataaaatataactatcttacccaaaattactaacatccagttaggtttcagatttgaggaatttaaagtttaacaatcatgtgcagtcagatgccctatgtttgtggattgggagaattaatattgttaaaatgtccatactacccaaagcaatctacagattcaatacaatccccatcaaaattccatggtaatctttcacaaaaatagagcacacatggggaaaggacagtctctgcaatagatgctgttaggaaaaccagctattcactgcaaaagaatggcactggacccttatctcaccccatatacaagaatcgactaaaaatggagtatagtctgaaatgtaagatctgaaactataaaataattcaaagaaaaacttagaggaaaagctgcatgatattggctgaacaatgatttttttgaatatgacaccaaaaagcacaggaaaccaaagcaaaaatacacaaatggggtttcatcaaactagaaagcttccgcactgcaaaggaaacaatttaacagggcagaaagacaaccatagatagagaaaaatatttgcaaattgtatgctgataaggggttaatattcaaaatatggcaggaattcaactccatagcaggaaaacaatcctgtgaaaaaatgggcaaatgatctgagtagacatatctaaaaagaagacatacaaatggccaaaaataaaagaaaaaatgtgcaacatcgttaatcatcagagaaatgcaaatagaaaccaaaatgagctatacctcacacaagttaaaatggctattatattttcagtttattttataatgccaaaattatattaaacgtatttttaaaaactggtttttgaaatatttatcttttatatacttgcagctactgtaaattattttattctggagaacctaaacagacataaaaaacaatgtaaagaattgacagtgatcaatatcttcttttacctccctttatcataatttgttttccagaaatatttaaaagtaagttttgacatcctcttacttctgcctcaaatacttcagtgtgcatatctgaaatacaaggattgtttttctacataactagcttggcattatcatgctttaaaaaattattgataaaagatttatcagtatttaatacccaatcttatatatatcttttaattttccccatgctatcttttcaatcttagtttctccatttaaaacacaaacaagcccttacattgttaggtacacccacagccatgagctcatccagtcatcccctctaggccccttcagtggacagttacttattaaaactgaggtgagcattctgattcgaatctggtttcagtgtttttatttaattttcttgagttgattctttcatctttactccctcatactatatgtcttgtttttttttaattccctggctcatttaaagttttcctttttatctcttgttttgatcaacttgattgggacatgcttcagtgtagctattttcatttttcttgtgcttaagctttattgagattcttggatctatgaatttaaaggtttcaccaaatcaaacatttcttagcctttaaaaaaagtccctgttccctcttttactctaggcattccaattaagtgcatagtgactggagtgcctgacggagatgattttcagtgaaagactttgagagccttattaggcacaccaaccagtcatccatttgaataaagtatattgggaggtatagatggagatctgaatctcatgaaagagtttcacactttttgctatttcctgaaagtgtcttatcatttctaaaatcatgctcttctttatgttatttcatgaatctgaaatgatctatatcaccccttcctttaccccatgtcgaaatgtaaatgataattataggacaatttcaaattttatttcttttaaaagatttgtgtaatctccccagttaaatgtgacctcttccaactctgcatttggcttatgcctcttttgagcacttttactttacctagtgttgtaagcactggtgaacttttctgtctactaggtgatcattaccttgagagcaagacaatgtgttacagtttttacgccccttatggtactggttctaactatagtgttttgatagattgacagcattaaactcattgattataatttatttattaaataattcatcaaaaaattaattactaaatattgcgaatggattgccttattttaaaaaatgaatttaaaaagtcatttaactctgttataatattcttgtatatatattatttataatttctgaaatgcaagataagggatagagctgcagtggtcactgaggaatgttaatttatcttcagtttgttatgtctatggtgcagcgttcaatgcaattcaattttatttcccatatgttggctacggaaaaggaacaatatcattgctttactggagctaatgggagataatttatatgttgatatgagtaactacttttaaatttacttcataaataccttagtagcattcaaattttgtatgaactttattggcattccccacaaattatatagtgtatagtaaaagaaataaaaaataactgtattgatcatattatgcaacattgttgagaactatttaagagtagataaaaaataaaatgttagatataatgaactaatactataggtagtgaaaatgatagtggagaatcatattgaaatgttgagtggaatgacaaaatgcagattgcttcaataaagcagaaaacctgcagtgtagaactaaaatgaagcatacttcaagtatgtagtgattctaagaatgttttctttctcttggacacttatagtgaatatgccttcctaacaatctttcattcaaaaccattgaaaagaaaaacatactaatactaaggatgcaaaccatcaaagctctgctattgttattcccaccatgaacacctgcactgcaatcaagcacaattcacagatgtgagctgaaagtgtgctgataagcacatgtctacctttcagattttcattgaataaatactacctggaagttcagaaaagtggaaattgaatgtgagaagacttcactcaaaaaagaaaaatctctcaaatgtttttccccattttttgattcatatcacatttcagttgcttttcaagaaaccaacttttaaaattctacttttttctacagacatcatgtgacatggtaatttaattaacatcattattctttcatttatatttaatcttatctctcagtcttgtcactgcaagtgatcaattcaaaacatttaaaaacaatgaggtaaaatacaataaacttgtacagattttcctagcttacagaatttggtaaacacggtagaatccatgatgatgccagagcacatttgttagaaaaaaaagtttcagtttgatcatgaaagttgggtgcatattctccatctcctatgatgtcataccgtgtgaccacaatcatgtctacttaattcattttggatgttttgatgtacttgaatttagaacacgtctgtcggaaagaggaattagtgcctttactaatgttaccattttaaaatatgacaaaacctaattaagagtactgcaagttattgaaacattctttatgtggctttttgtttggtcactctattatatagcaaatctgtccaaagaatggaacttataaagaaattttaaaataatttcattttctgctgatggcaacctttttatgacctaggccatatgacaaagaatacacttaataattcagcaaatgatgagaaactaatatgttccaagcagtccagttagtactaaggatgtaattctaatctagataagtatacagttgattgcagagagatatgtacatagataatacaatgagaacttgtaaacacaataagagtatgcaatcaacaaatacatattgaacaaccactatgtcccaagcactgtgctgaaatttacatacgccaaaattccagtaatagtggaacaatatttctactggaaaatgtttaaaaaaatttatagagatagtacttaatctgcattttgaagataaatatgtttttaaatgaagatgagttcaagatttcactgctaaagaagcaatgattataaaggtctaagctgaatctagatttaaaaagtagtgagtgattgtcactgaagcccaagataaatggggaggagaaggaaaagctattggaggtgcttttgataaatatctggtagattccttagggggattatttcctttaagagaaatttggtaatctcattagccttttctgttctgggagggtaagcttcaacccagcccatagaggtctctactagtattagcaaaaacttgtatcctttgcaagctggcatgtaggtgaagtctaattgccaggtgacatagtttgtccagaacaatactgattatatgactatttctgaaatcatgattaacagtgtcccttttcactcccaaaagtttctttggtctgaagataaagtgcaaggttattttctatagaaaagttaacttacagagttctacacatcagccctttagcaacagtaaacagcagaagactctaagtggaaaagtaatgcacatgcctatccttaaagataatcctggcagcaatgtgaagaatagtcaggaatgagactgaaacaggatgatggtgtatgaaacgtgttagcacaaacagaaacaaaggagtttgaattagagcaatgcaagtgggaaggagaggaatcctaccataggaagaatttggtctttttcatgtcttctctggaaaagagctagaacacattcttactttccttttcttctctgtgtccttatgacatcgtttgcctattcatgacatcttgaactcatcttcatttaacaacatatttacctttcaaaatgcagattaagtactatctctatgacatcacttattgtctgagttgtttttttgtttgtttgttttgagacagagtctcgctctgtcgcccaggcttgagtgcagtggcgcaatctctgctcactgcaagctccgcctcccgggttcacgccattctcctgcctcagcatccccagtagctgggactacaggcgctcgccaccacgcccggctaattttttgtatttttagtagacacggggtttcaccatgttagccaggaaggtctcgatctcctgacctcgtgatccgcccgccttgacctcccaaagtgctgggattacaggcgtgagccaccgagcccagccacttattgtctgagttgtaattactacaggcttgtcttgctccctggacttgagagtaggaactgtctcatgtcacttttgctagtctgttcttgcagctgttctcaacatgtgcacggcaatctacaagtatgtgtaaaagaatgtttgaaggtaattatacaattgtgccattgtggaaagcattggatacaatgcctaactgcataaaaagcatcggtatttctttaacttgagaacacatactgacatgctcctcgtggcctgaatcttgtttacctccctaaagctccatctgttgaattttccaactcattttctccagggaaagaaagataatgcctgattcattgccctccatcacttcacagcagagaactaatctctcaattactcacaatacaaatggcgctgtgtgactcccacggtaagactctgccctatttttctccaaaggatcttaatgggggacaaagatctgtgcttccaataccactgggaaaatttccttaagtagatttgagaaactgaagcttttctgtcaattcctgaattgtgttatctgtggaaatttagactatagagccatgtatatcagttctaaagtgttgaaatacacattctatatatgtatatgcaacaatgtgtttacataaaaaataatacatgcacatccatcctatcatcaaccttctattttaatatacctctctttttgaggacttttcaaggtggtattacatatattttctatttcaattctataattcttacgttttatcaatagaatacatatatgtgttctacctgtgtatatatctacgtatgtatatttatatatatatgtatgtatatgtatatgtgtgtatatacacacagaacacatatacacatatatgtgagtatatatatctatgtatacagatatatatacatataatgtatttcttctatttgtttacctagtgttatagctcctataggaaagccaagacaaaggctcgattctatttatttaacgatttttggaaatgatttcatatttatagtagaaatacatacttacaaaagtacaaaaattagctggacatggtggtgcatgtctgtaatcccagctactcaggaggctgaggcaggagaatcgcttgaacctgggaggtggagatttcagtgagctgagatcatgctactgcactccagcctgggggacaaagcaagactccttctcaaaaataaataaataaataaacaaaaaggaatgctactgatttttgtatgttgatgttttatactacaactttactgaatttatcagttctaatagttttttagggaagtctttaggttgttccaaatataagattacatcctctgcaaacaaggataattagacatcttccttttcaatttgtatggcctttatatctttatcttgtctgattaatctagctaatacttccagtactacgttgaataatagcggtgaaagtgggcatccttgtcatgttccaaatctaagagaaaagacttttttcagtttttccccattcagtatgataccatctctgggcctgtcatatattacctttattatgttgaagtatgttgaattttatcaaatgctttttcaccatcagttgaaatgattatatggtttttgtccttcattctgttgatacaatgcttcatattaattgatttgcatatgtggaaccattcttgaatcccacatggttatgatgaatgatctctttaagatattgttgaatttggtttgctagtattttgttgaggatatttgcatcaatattcatcagcaatattggcctgaagttttctgtttttgatgtgtctttgtctgttttggtgtcagggtaatactgacctgtagaataagtttggaagtatttgctcttcctctgtgtttcagaacagtttgagtaggattggtgttagtcgttctttcaatgtttgatagggtttagcagtgaagacattgggttctggacttttctttactgggagactttttattaaggcttcaatctcattcttcgttattggtctgttcagggattgtatttcttcatgtttcaatcacgataggttgtatgtgtctaggaatctgttcatttcttttagatttcccaatttattggcacaaagttgcttatagaagccacaaatgatcttttgaatttctgccatatcaattgtaatgtttcatttttcatctgtgattttatttatttggatttttttctctttttttcatagttagtctgactacagatttgacaattttgtttatctttcaaaaaaccaactttttgttgaattgatcttttgtattgttttcttcatttcaatttcatttaattcttctctgatctttattattgtttttttttactacttttgtgtttggtgttctgttgacatttctagttctttaggatgcatcactgggctgtttatttaaagctcttcttcttttttaatgtaggcacttgtagctataaatttttatctttgaactgtatttgctgtatcccacaggttttggtatgttgtgtttccaataccatttgtttcgagaaattttccaattttcttctcaatttcttcattgacccactcatcattcaggatcatatcgtttcattttcgtgtgtttgtatagtttccaaaattctacttgttacttatttctaattttattccactgtgctcagagaacatacatgacattatttcattttgttaaatgttttaagacctgttttgtggcttaatatgtgatctatctttaagaatgatccacatgctgaggaaaaaaatatgtattttgtggctgttgggtgaaacgttctgtaacattacacgaaatatacctgatatacatataggtccttttgatttatagcacagattaagtctgaagtttctttgctgactttctgtctgaataatcagtccaatgttgaaagtgaggtgttgaagtatccagctattattgtgtccaggtctatctctctccttagctctaataatatttgctatatatatctgggtgctccaatgttgggtgcatatatatgaacaattgtggtatcctcttgctgaattgactcctttatcattatattaccttatttgtctctttctatagttttatcttgaaatctattttgtctgatataagtgtagcaactcctcctctttttttggttttaatttgcatggaacatatttttccatccctttattatcagtctatgtgtgtctttatatgtgaagtgtgtttcttgtaggcaacagattattgggtcttccctttttattcatttagccactctatgtcttttgactggagagtttagtccatttaaattcaatgttattattgataagtaaggacttacttctgccatttgttgttttcttgttttgtggtcttccttccttctttctttcctgtcttcttttactgaagctgactttctctggtagcttgatttaatttcttgcttttcaatatttgtatacttgttgtgtgcttgtagatttgaggttaaaatgaggcttgcaaataatatcttataacttattattttaaactaatgccagcttaacagtgattgtgtaaacatataagcaaaaagaaaactaatataaactgtacactttaactttgttcccccaatttttaagtttttgttgtttctatttacatcttattttactttttactgtctatgtcttaaaaatgtgttgtagttattatttttgatcagttcatcttttagtctttctacttaagagtagtttatacatcaaaattacagtgttataatattctttattttctgtgtacttacttttaccagtgagttttgtgctttcagattcagatgattttttattgcttattaacatcttttttttcagattggagaattgcctttagcatttcttcttttttttattattatactttaagttttagggtacatgtgcctttagcatttcttataggtcaggtctggtgttgataaaatccctcaggtttgtttgtctgggaaggtctttatttctctttcatgcttgaaagatattttcactggatatactattctaggaaaaaaggtgtttttttctttgtttgttttggtttgctttgttttgttcttcttcagcactttaagtataccatgtcagtctctcctgatctaaaaggcttccactgggaagtctgctgccagctatattggagctccattgtatgctatttgtttcttttctcttgctgcttttaggatcttctctgtgtccttgatctttgagagtttgattgttaaatgtcttaaggcagtcttttttgggttaaacctgctggtgttctataatcttcttgtatttgaatattgatatatttctctaggtttggaaagttctctgctcttattcctttgaataattgttctattcctatctctctttctactccctccttaatggcagtaactcttagacttgcccttttggggttattttctagatcttgtaggcatgcttcattgttttttattcttatttcttttgtctcttctaactatatattttcaaatagcctgtcttcaagctcactaattctttcttctgcttgatcaattctgctattaagatactttgctgtgaccaggcaaagtgactcatgcctgtaatcccagcattttgggaggccaaggaagcagattgcctgaggtcaggagtttgagaccagcctggctaacatggtaaaatcccatctctacttaaaatacaaaaataagccaggggtggtggcacatgcctgcacttccagccactcggggggctgaggcaggagaattgcttgaacctgggaaacggaggttgcaagattgcaccactgcactccagcctgggcaacagagcaagacttgtctggaaaaaaaaaaaaaaaagatactctgatacattcttcaatatgtcatttgcatttttcaactccaaaatttccactagattctttcacttatttcaatctctttgttaaatatatataatgggattctgaattccttctctgtgttttgttgaatttcctcaggttccctcaaaacagctattttgaattctctgtctgaaaggtcgtatatctctgtttctccaggattgctccctggtgacttatttacttcatttggtgaagtcttgttttcttggatgctgtggatgattgtaaatgttctttggtgtctgggcattaaagaattaggtatttattatagtcttctcagattgggcttgtttgtgcctgtccttcttgggaagacttacttgtaccctaagccaaataatgctgttgattttacagactcatagaggtactatgttggaggtcttggaaaagatccagaaaaattctctcaattaccagccagtgtcttggtgttttcctttattttctcagaaacaagcagagtctctttctccctgtgttgagccaccaggaactagggatgtggtgatgcaagcacctctgtggccaccaccactgggactgtgctgggtcagacctgaagccagcacagtacttagccttacccaaagcccttatcttcagggtggcaagatccccagtccctgaacatgtccagagatgctatctgggagccagggattggactcaaaactcaaaaactttaacaatttaccaggtgttctattctactacagctaagctggtgcttaaatcgaatactggggtttgaagaggaaaggcacaagtcttcccttagctattccagctagtgtctccttaggtaacatgtcaccctaacccacctgctctaagcccagcctagcactaggatttgcctagcaattgcagtctttgtatcctatactgcctttcaagtttacctaggaccccagagcccttcagcctatgatggcaaggcttgcagagaaacttccaactgctgggatgggccattcctctccagctagggctggtaaatattttccctccttgtgccggccctggctaatcccaatatggttttattctctgctgtagcagggcagcactgagtttgatgtaaagtccctcagttgctgtgctcttcctccccaagatgcacagattctgtctccacagtgcatggcattggcaatttatgccacagttgttggcattggcaatttatgactgtctcttcggccctcctcaatactctttccataatataaagtttaaaccaggtactgtgattgttcacatgattttcggttcttgtaatggtgcttttctgcatgtggttggttgttaaaatttggtattccagcatgtggtcggggtaggagggatgaacagtactgtgagcttctattctgccctcttgctctgcccccaaatctccttgttttggcttgcatttccctctttagttcctggtatattttgaacaacattcccttgtaggatatgccttttgaaaatattttttggcaatatttttccccaatatatggcttctcttctcatttccttgagagtgtcaattgtagagcagatatgtttaattttgctgaactctagcttatcaataatttctttcatgaactatgcctctggttatatatctaaaaagtcatcaccaaatgtaaggtcatttagattgtcttctgttattcctagaatttttgtaaacttgtgatttacatttaggtgtatgatcccttttgcattaattgtgtgtgtgtgcattttatacatatatatatatatatatatatatatatatatagacagagagagagagaatactgtgtgtgtaatacacacacacacacagacacagatagatcaatagaacagaataaataacccagaaatagacccaccaaatatatgcatatatacatatataaatatatatatgtatatcttgattactgtagttatatggcaagtcataaagttaggcagtgtcagtcaatccttcaactttgttctacaatattgtattgcccattgtgtatcttctgttttccaatcttaactttagaatcagtgtggtaatattcaaaatataactctctaaggcttctactggaattgtaataaatctataaataaaatagcaaagaattgacatcttgacaattgagtctatccataaatagaaaacaatactttattaatttagttgtttttaaattaatttcattcaagtttcatagtttttctaatatagatcttgaacatttttaaaaagatttatgctgaaatatttcatctttggggtgctaatgtaaatgatattgcatctttaatttcaaactgcactaggtcattcatggtatatagaaaagtgattaaaatttatatattaacttcatatcctgcaagcttgctatattacttattagttctaggagttattttgtcaattatagtattttctatgtacactatcaagcttgcaaacaaagaaaacttgttaaaacttgcttaaaaagcttgcaaacaaaacattcttcaaatcagtacaccttttatttccttttcacatagtattacattagctaggacttcctgtatgatttttaaaaggaatggtgataggaaacatctttgccttgttcctgatctcagtggaaaagcttttggttttctaccattatgtgtgatgtcagttattctgtaaatgttctttttcaagttcaggaggttttcctctatttctagcttgctgagagttttcttcatgaacagatgttaaattttatcatacttttttttgtgtacacatagataagatcatgtgattttttattagcttgtgaatatgataaattacaataattaattttaaaatgatgaaacagctttggagcctgaaatgaattccaagtggctgtagtgtatagttgtatacactgttggattttatttgctgtcattttgttcactgtctttgcctgtaattttctattcttgtaatgtctttatattgtttttatattagtgtaatacctgcctcaaatgagttggaaaatattttctccaattctgccttctggaaatgcttgtagaaaattggtataatttcttcctaaaatgtttggtagaattcatttggtagaagcgttttgcttcctgcttggaaaggttattaattattgcttcaatttcttttatagatataggactattcagaatgactgtttcttcttgtgtgagttctggcaaattgtatctttcaagaaatcagcccgtttcaccaacattgtcaaatttgtgggcagagagttgttattttatagtattttttgttattcctttaatttccatgtgatctatacttatgtctcctctttcatgtctgatattagtaatttgtgtcttgtctctttttttttattcctagttagcctagctactgttttactaattttattgatcttttccaagaatcagctctttaaaaaaattttctctattgattttttttttcattttcacaggcttttgctctaagtttattattttcttccagttacattgaatttcatttactcttatttttctaattttctaaagtggatactaatattattgattttgagctcacttttgttctgcaaatgcagtatatgtcctaaatttccttctaagcactgctatctctacatcccacacactttgaaaagtggcgtttttatttttatttactttgtttgaaatatttttaatatcttttgatctttcttttttgagccatgttttctttagaagagtgttgtttaatcctcaagtgttttgtgattttctagatatctttctgttattgatttctagtttagttccattgtagtgtgagagcatatattgtatgatttctgttcttttaaatattttaagttgtgttttatggcccagaatctggtctaactttgttaatgtcccatgtgagcttgagaagaatgttgtgaataccaattagatccacttgattgatggttaatattgagttcaactataagcttactgcctttatgtttcctgggtctgtccatctctggtagaggggtgtttaagttgcaaagataatagcgaattcacccttttctccttgcaggtctatccattttgccttacatattttgatactttgctgttagacacatacacactaaagactattaaatctttttagagagctaatccctttactatggttcagtactttactcctgttactttttcttgctttttagtctgctgtctctgaaataagtctttctaccccagctttcttttgatttgtataaacattgtatgtctttctgtatcctcttactttgaattgtgtgtatcttcatatttaagtgggtctattataaaaaacatatagttgatttttatatttttatccactctgacaacctgtgttttaattggtatgtttagaccattgacattatactggttattgataccattagataaatgtctataatatttattgttatttctattcattgcccttcttctttgtttcatttttgtcttccattctgtttctgcattttttatttcaattgcacattttatatgcttccatttactctccattcttaacatgtcagctccttattttttcacttatttttaaagtggttttagagtttgcaatatacatttacactgaatctaaagcaacttcaaataactacttctcttcacagatagttcaaataccttctaataacaaaatattcctaattcctctatctcatttcttttatctttgttgtcattcatttcacttatatataacctattattatgaaacacattgttgctattattattttaacaaacgttttgctgttagattgattaataataataaaaataaaagttttattctaccttcacttataccttttgtaattatttttctttatgcagatccgagtttctgatctatatcattttacttcactcttaagaacttcttttagcatattttgcaagacagggctattggcaacaaattctctgaacttttgttagactgagaaaattttagctttcacttttgaaggataattttgcaagattcagagtactaacttcatgcttttgtctgtcaactttaaatatttcactccactcttcttgcttacatggtgtattagttttttttgatgctgctgtaaagtaatacccgagactgggtaaaggataaaggtttaattgacctacagttctgcatggctgggaggcctcaggaaacttacaatggtggaaggggaaagagaagcaaacactttcttcacaaggcagcaggacagagagagcatgtgtgaaggaggtactgtcaaacacttataaaaccatcagatctcatgagaattcactcactatcatgagaacagcataggagaaaccacctcatgatccattcacctccctccctcagcatgtggggattacaggtccttccctagatgtgtggattttataatgtgaggtgagatttgggttgggacacagaaccaaacgatatcattctgcccatggcccctcccaaatctcatgtattttcacatttcaaaacacaatcataccttcccaacagtcccaaaaagtcttaacttatttcatcattaattcagaaatccaagttcaaattatcatctcagacaaggcaagtcccttctacctgtgaacctgtaaagtcaaaaacaagttaggtacttccaagacacaatgtgggtgtaagcattggataaatacttccattccaaatgggagaaattggccaaaacaaaagagctataagtcccatgtgagtctgaaatccagcagagcagtcattaagtcttaaagctccaaaataatcttttactccatgtctcacatccaggtcacactgatgtaaaagttgggctcccaccctgtggcactgcagggttcaacctccccgataccctcccctggctgctttcacagctggcattgtctgtctatggcttttccaggtacacagtgcaagctgtcattctggggtatggaggacagtggcccccttcttacagctccattaggcaggatttcagtggaaactatgtgtgggggctccaactccacatttttcttctgtattgccctagtagaggctttccatgagggctccacccctgcagcagacttctgcctggacatccgcgcattcccaaacatcctctgaaatctaggtggaggttcccaaacctcaattcttgacttctgtgtacctgcaggcaaaacaccacgtagaagcttccaagatttggcccttgcaccctctaaagcaacagcccaagttgtaccctgaccccttttagccacactagagctgtagtggctcaaatgcagggcacgagatcccaaggctacacacagcagccaggtcctgggcctggtccacaaaatcatttttcctcctagacttccatgcctgcaatgtgagaggctgccaccaagatctctgacaagccctcgagacatttttcccattgtcttagtgattagcatatggctcctccttacttatgcaaatttctgcagctggcttgaatttctccctagaaattttttttttctattgcatcgtcaggttgcaaattttccaaacttttatgctctgcttcctttttaaacataagttccaatttcagatcatctctttccagtaaaatttccacagatctctaaggcaggggcaatttgccaccagtctgtttgctacagcacagcaagagtgacatttgctccagttcccaagaagttccgcgtatccatttgagaccacctcagcctggacttcattgtccacatctaatatggtttggctgtgtccccacacaaatttcatcccataatccccaaatgtggtgggactcagttggaagtaattgaatcatgggggtggttaccctcatgctgttcctgtgatagtgagtgagttcacatgagatctgatgtttttataagggggtttttccccttttgcttggcacttctccttcctgctgccacatgagaaaggatctgtttgtttccccttccactgtgattatacattttctgaggcctccccagccttgctgaactgtgagtcaattaaagctcttttctttataaattaaccagtgtcaggtttgtctttatttgcagcatgagaacagactaatacaacatcatcatccgcattttggtcaacaccattcaaaaaatctctagaaagtttcaaactttctcacatcttcctaccttcttctcaccctccaaactgtttcaacctcttcctgttacccagttccaaagttgcttctacaatttcaggttatctttacagcagtaccccactatcccagtaccaatttactatattaatctgttttcacagtgctataaagaaatacctgagactgggtaattgataaaggaaagaggtttcattgactcacagttccacatggctggggaggcctcaggaaacttacaatcatggaagaaggggaagggggcacagtaaacttcttcacgaggtggcaggacagacagcatgtggggaggaggaactgacaaacacttataaaaccattcgatcttgtaagaactcactcactatcacaagaacagaataggaaaaactgcctccatgatccaaccacctccctcccttgacatgtgaggattaacaattcgagataagatttgggtggggacatagagctaaaccatatcatgtgatttctgaggagaaacaggatataattcttttttttgcttctctacaggtaatatttttctagctattttccaaaatgtgtttctatattttttattttctaaaatataaatatggtgcactaggtatttatcatgtgtgtgtgtatgtgcacatttgtacgtacatgctatataactgtcagggaaatcatcggctagtagaaattgaaatagcacacagacaggtgggcagacacatgtggtacgcttgttgtattttttactaagtgtgtctttacagcagcacaccttgtggggctggtgtaccctctaaagtaaagtgaagtgtgtctaggacatctgattttgactgagggaatcagaagaaaaatctctgatacagtttgcatgaacttgagaccaaaacgatctttaattagtgttccaagctagagaaacagccctgagtgaggaaaaggcatggtatttttggaaatttaaggagagctagcaagtctggaagaatcaaacaagagaagaaatcctgcagctgagaatcagatgatacagtgtccatggtcagaatttttccatttcagtctaaatttaccgagaagccattggcaatattcaagcatagtcttggcaggtgagtgcttcatctgggtacttatggacaatagactgaatgatgtggttaagagaagtatctgcatgagagatagcagtagcttgaatcacatggtgcttgctggtatagagaaggatactgaatcaaggtatagtttgaaggtacaatggacagatttgccaggagattctgtgagtgagagggaagatttctcaatttctttacgtcagaacttataatgagaacaactgggtagctgaagatgctataatctaaagtggagaagacagcagaaaaaagtgttcatttaaaatattttaattttcagaatttttcagaagtcagtcatgcctgagctaaggaaaaagatgcagatggcaaatttttgttttttaaaattatagtatcagcaaatggaatcacaaaggtgaatgtagaattctgaggccatgctgttaagtagttgcagatccataatttaattctaagcttctctgactctcaaatgcatgttcttgactattgagctgtggagctagacaaccccaaaatttttatgaaatatgaaaaatgttctgatctttccatctattcaaatgagctaccatgttgtaagcaccacatagtctgtttatgacatacatattattcctattcttttccccaatcctgcatgtgattgtcattattattcattttttccagaagaaaaaattgagttttggagagttaaaaacttattgggtcctcatttcttgaatggctttcctctacagtgtgccctcgtgtacatccatggcccccaccaggcaagaaaacagagtccccacttaggagaaaattattacttaagccttgtttttttttttaaaatgtgttttataattaatactaaaataaatttcactgaggtgtgaatcaagtttgtttgggaaataaaatattaaaatacatggaatcgtgtataatgtttgacaacatctgcatgcttacttaatcacatgatctccctgatggaatcagctcttaagttgagatctgacaccatcttatatagataatgtatgtcataggcatacatggctcagctactgaggcaatcttctctctgtaaaattaaaataaaagttttgccagcaattaatctccttagccgttagaatagattatacaccagtccttggagtgcaaggaagtgagcatgtgagagtgtttgaagacctggcactaaatgattacaatgtcaccaggagagagctcagttacaaaatagtacagttggagcagcttatttcttctcaagtacaattactttgttctcagaaccaatgtaatcattggagcacgtttatttcttctttgttctcacattgtgagtatgtgttagcatgtagcctaatgcaaatatggtaaaatatattatatttgaagctagctagcaatagtttgatatattttcagatatgaagatataaaaaacaaataaaaaacttttaaaaagtcattgctaactttgtaaaaacgtaatatatactcaagactcagcctgctgggctcaggttctggccctggccccatcacagaacagctgtgtgacttcgatacaataacttaacctctctgagactatgtatcataatttataaaatgggaagagtgaaagtgtctacctcacaggtttgccatagagattaaatgaattaaccattattgataaatgttaataatggtgtctaatacatattgaatgtttaagtgtttgtttgcaagtattttcctgacatttttgaaatatatgtgttttatatgttccctaaacttttgtatatcttcttacctcatttattagccacaatttgatcatctgaattcctagctgaataactggtaccatgtttataatacttcagcttctcctagtgtttcaaagctacctcctgccatattttgctatgaatgtactttcttatttcttattatgctggaaacagcattacctagcagtagcaaaacatttcttatggaagaggaacaaatatatttcttgttgagattgtagctgcaaaacttctctcgcttgagttcccatcatgagaatggcgttatcagagaaatacagaaccaaaatctttatgaggccaacgttgtttccaaacatttcttaacgttcccttgattgaccaaaataaactaactaataataaggaatcaaatcctccagaaaaaaataaaaatcaaattaaagaaggaattaagactactaaggtaattcttaggacaaatgaaatcaaattgagctctcattatctccattaaagtgccacatggatgcatacaatcttacatggataatgtacataatttagattcttgtcaaaaaagacactgcagcctctgcctcccgggttcaagcgattctcctgcttcagcctcccaagtagctgggattacaggcacccatcatcacgcctggctaatttttgtatttttagtagagatggggttttgccatgttggccaggctggtctagaactcctgacctcaggtattctgccctcctcggcctcccaaagtgccgggattacaggcctgagccaccgcgcctggccaggagcacatttttctaaatcaagcatgaagacaaaagtgcacatggcagcccccttgaattcagcctcttgccatgagccaagaatctatgtataccatgctggactcttgagttacagaactgaaagcaaataaagcaaagttgttttaagccagtaactttgtggtgatttgttatggcagcaaaaaactaacaaaaaccataacaaaagcaagctgccttcagctttctctgatgagtttctcccctgtaattgtcctgttctgcattgtttgcctgggattttgtcctcatttatatctctgctaaaaaaaaaaaaaaggaaatagcagccctcattgctcaaaccagtgtatggttttcactactcattttaccttatttctgtagcaattgaagactaacctgggagaacatgctgaaaggtaggaaataaaaacagcaacatagtgtcaaagtccagaaatgcccattgctgtgctatctgggcaaattactcaacctctttcaatcaaatttctttataaaataataaagaaaaatgagctttccttataagattgtgtggattaaatgggataatagactgaacaatatttctccaagcagcttaaaagccatttttcaagggtgtttttctaacctctaaatcttcgaggctatgctcactcaatgcacctcttctcctgcacttattgtaacttgaaaatatagttaattgtgggaatgtgttcatgcccaactcttctgctagattatacttacaaaggagactatttttgttcactgtaatattcctgtgtgtggtgcaggacctaaaaaatattaggtagtcaatatatatccgttaaataattgaacattaagaatgtgtctaggatatattaagtgttcaaacaatgttgatttccttccttacttgaccttgtcttgtttatcagcatttagggctgcattttgtgttgtttcttctccttgttctattccttctggtttcatgtgctttctctttttattagtttcatattgcagtcataacagataaccacaaacttggtggtttagaacacccacatatcatctcaccactctggtggtcagaagtctgagcatacaacatggctcaacagcatccactgctttgcttatcggaaaactgaaatcacacgtcagcagagcactgtttcctgttcaaggctccggagaaatatctgcttcctagttcaatcaacattttggcagttgtttgtggtaggaatacacattggttataggaatgaagttcccatgttcttggtggctatcgccagggcactgatcattgtacttagaagtctctttctgtctgtgttcatggcccctatatctcaaaaccagtatggttgaatcaaatccttctcacacttggaaaccatcagactgctctctctcatatccttaactccaatgggagggagttcctacttttaagggctcctgtgattagactgtgtccacttggatactccagggtaacaccaagaacactcttacaccaccgcatggcaaggcctctagctttctgacctctaatgccagctaagtcatagccactgccaattctatgcttttatgttttattattttattttattttattttattttattttattttattttatttatgttacccttatgggatcacatcacttgggggaaacaatttctacattagtcaaggtaagtcatgttatataggtatataacaatcacaaaattccagtgccttaaaacacaaaggtctttcagatgttctattcttcctgtgtcttccgaatccaccatctttgatgtacacctgtactttaacttcaggaagggtgagatgaattaagtattatgtgttgggtatagaattgggaatatgaattttatccacattccattggctaaaactcaggccatggtccctgcaaactgcaaagaggactgggaaatgtaatttctcttaatgttccaggggaaataaaaaagaatttggagaccatagagcattctcttcatcctgtagactctttccaattgaaaagatttctaaacatattcccttctatactctgaatctgtattcatagattttctctcaacatctagtcaattccccatgtttctgtgcactgcctgctgtttcttctttccataatgctctatccctgtttatgtgaattgagaggtattattcaattatcagtgccaattgttttgaggcactggtagaagatttatgaggttcttctagattgtctaaaccagaggtggtcttttttttccttatatttttaacaaaaacctatttatttacatgctgcatatcaaatgaaacatagttatagtttgtcttttcaaaatgtagttttcttagggcagaaattatgtctgtgaatgcccagcattagcgaagttccttacatatggtaaacccacactatgtttgtttgtttgaaggcttaatatgtaaatgaatgtcctaataaataacagatttattgaatgtatttgtcttagtaataataactcatgcttatcttgaccttgctgtgtgctaggcatgagttttccaaaatgtagaaactaaggcactgaacagtgaaataactccataaaatcatggcctaaggagtagtagagatgactttgaacccatagattgtggccattgagtttgtgttctttactactatatgtctgttaatttcagcattattaaagaaaataactttttatttctatatattatgtgtcagacattataatcattgctgttgctctttttatcttcaaaagttccgtacagaaaatgtattgatagtccccctggcttttttccctgcattgcatcagattagaaaaatgaggaatcaggctgcttgtttctgctcttacatgtaaatgacttggcagttgtcactgtcttctctgcatcaagaacaagtgaacaaactgtatagtgacaactcttcttctaatcacagagaaaaccaccacgcctaaaactggagaaacaagtgaatacagggaaccacagcttactaggagcagaaaccatcattggtgccaataaattacagagaaacttaaactataactgatgaattggtggttgctcaatgtggactagttggaagttaaatctcctagaggtcaagcctcaaggggaacactgctctttcatgagttttacctccaggagactcaccaggttatcactgtaacaatctgagaaaaatttctacccgtttcctgcaaggaaaggagaaaagcaaccatgtttaaatatacccagagcattctgttctgtttaacaaaggtctcccctcaagaaaaacctagtttattagaacccacctaacatggaagaagggaaataaccccttgaagacccctcaaactttcctgtctcacctatgggagatgaaagaaaagctgagatgtatttgttagggtcgcaacccatgggcacaggttcactgaaagactgagacctagtcagaaggttatggaatacttcctcctttctcacattttatcccacatcaacaaggctgtagcataataatagtgaaatatagttgaaaaatttatgaggatataactttatttaagaagtgtcttttaggccgggcgcagtggctcacgcctgtaatcccagcactttgggaggccaaggcgggcggatcatgaggtcaggagatcgagaccatcctagctaacacggtgaaaccccgtctctactaaaaatgcaaaaagttagccgggcttggtggcgggcgcctgtagtcccagctactcaggaggctgaggcaggagaatggcgtgaacctgggaggcggagcttgcagtgagccgagattgcgcctgcactccagactgggcgacagagcaagactctgtctcaaaaaaaataaataaataaaaataaataaataaaaataagtattttttgagtttgcatacaaactcaaatgcaaaaagggagacaaaaacaaggacactggaggaaatggaaacttccggcatctacagctgcagcaagcagtaaacacagcctaactcctggcaagacaaatgcaatagctcacactaatgatctactcacatcagtttcttttaccagggcatcatgtctggctttcaataaaaacccagaaggcacggtaaaaggcacataatacagtgtgaagagaaaaaactagcaacagaaccagaatcagatatggcagagatttttgaattaatgaattggtagtttaaactaactatattatgctaagaagtataatggaataaagttgacagcatgcaagaaaagataggtgatgtaagcagacagctgaaaactttaagaagataaccaaaagaaaatgctaaaaatcaaaaccattgtaatagaaatgaaaaagttacagtctttcatgaaattattaaactggatacagctaaggaaaaaaatagtgagcttgaagatacgtctatggaagctatctaaactaaaaattaaaaataaagactgaaaaaggaaacagaaccgtatacccaagaaatgtggaacaatttaaaaaggggtaacttatgtgtaatgggaataccagaagaagaagaaagaaaacatgtaggaacagaataaatatttaaaatgataatggctgagaattttccaaaactaatgacaggtaccaaacttcagatactggaatttcagagaaatcaaacagaatatacagaaactaaaagcaaaacaacacaaaatactatgcctaagaaatattttatagaagctgcagaaaatcaaagaagaaaataagccagagaaaaaaaatcaccttacttagagaggtataagtataggaattacattggacttctcttagaaaccatgcaaagaagaaacaagtggagtgaaataattaaaatgttgaaaatttcattaaaaaacacacccaactggaattctgtatcaagttaaattatccttcaaatgtaaagaaggaatgaaactcctcagtcaaacaaaaattggggaacatattttcagttcatcctccttgctagagctataaaagaaattcttcagagagaagaaaaatgatatgggtcagtaacttatgtatacattaaaaaagagaattaaaaaataaataaaaacaagatcttgtttatatttaatttagctaacagctcttctgtgaaataataataacaatggtctatatgctgattatgccttatggataagtaaaatgaattacagccatgttataagagataaggaaggtgaggttttgaatattctactataaaccacatgcattatccatgaagtgttttagtatagtagtcttatattagttttaaatgtatatttctaatattagggaaatcactaaagtaaattgaaaatataaataaaattgatatactaagagggaagtaaaaatggagtcataaaaagctcaattacaacctgagaaggcagaaaaagaggggaaaataataaagaaacaaataaaaagggcaacaaacgaaaagcaagtacatatgtagtagttattcatcctactatgtcaacaatgacttcaaatatgactgctctaaatatactcattaaaatgctctaaatatatccattaaaagacagactttctgtgtagataaaaataaacaagagtaaactatgtattgtgtacaagaaatccactttaaatataaggacacagataggttaaaagtaacaaaagaaacacagaaaaagagaagtatttagatacaaatccataaaaatacataaaggatctacactgtgaaatccacaaagctctgaagaaagacattaaagaagatataaataaattgagagatattccatatttatgggtgggaagaaatattgttaagatgttgatttttcctaaatttatatatagtttcaacacaatctcagtcaaaattccagcaaggtattttgtagatactaataaactgattctaaattccacatggaaagcaaaagcccagaatggctaacacaatagtgaagaagagcaaaacagaagagctgaagaactgacactatcttatcttaagagtttctataaagctacattaaccaaaacagtgtggtgttagcaaaagaatagacaaattgatcaagataacagaatagagaagtcagaaatagccctgcacaaatgtagtcaattgatcttgacaaaggagcaaagaccacaaagaaaggataatcttttcagcaagtagtgctgttaacaactggacatccacatgaaagaaatgaatataaatacatttcttacaatcctcacaaaaataaattcaaactgaatcacagaactaaaagcaaaacacagaatgatcagttttgataaattcctaagacaacatggcagaatatctagatgaacttaagtttggcaatgagtttatggatacaataccaaagcatgatctatgaaagaaagaagaaaactgaaaaattggacttccttaaaattaaaaacttaattttccctcactaatctattgattaaaagtagattaaaaatgatgcactctgtaagtctaggactttgtttttgtctgtacattatctctaaaatgtaaaaaatacttcttggtgcaaaataggtactaaaattgtttaatgacaatttgcagagttcaaagtaaagcacaaattgcttcacttgttcacacacaaaaaaattttacttttcaattgagacttaattcatctaatccaaacctccaaatgtgagatagttacaaatgaaaacaaagaggttaagattgtttgagttttacttaattcagctgcttttgttgttgtttggttgtatttttctggctacatagtagtttggccaactgtaggcaatgcagccttaaatagagaggtttagtaccaagcctccttaaagggatttatctctttccatatatattttttcctatagaaatatttaacccagtactccttttggaacattgatacatagtcagtactattaaaataggcaattaatattgtggagttcaaacatgggacaaataagagttggaggaatggtgactaacatattttttctctgcttgttccacaaatggtactttttcccccatctgcataatcagatttcaaatttaatgaatatttgctacagtcatttctatgtataatagtgagctaatatgataatatttattaatttattcaacaaatatttatgaaagtgtcctactgtttgctactcctttgaatacctaatgatgatagatgaaggaaatgaaattaggggaagattgacatgagtcataagacgtgtggctgaaaataaattttaataggaggaaagaaaaaattacccaactggggagaaaacattgtagtaaaaaatgtaatcatttaattctgtttcccaaatgaaatggactttaattcactacagggcaactaatattagtagggttaaggggaaccattagtggtgccagtttgtaggtgacagtagtcacctttgccttgtaaacttaactgatattgagagtcttaatagccataggaacatgacaagataattatcactgaagaataataacaagctaaatgcagataaagttaactttttattcattttgaactatgccagaaaatagttaaatagatgaccattttccaaaaccaaattttgtatgattgcctatttccatattttcagattaaatttctattccaaatattgtgcttttcatcatcatttcatccaagccactcttatagtctggatggctgtaaaaatggcataatcactatgtgtacagtagcaattttgtcattacttgcagaatgacaataaatatgtaacttgtttttgcttcaaagaaaaaatagacctgtataaaaggcaatttttttccttctgctcattttagttcggcatgaagtagtttaaaagtttccaggataatatcatgcacccttttaacattacagatgccaccttctggaagttacaataaatacttaagcacagttgtgaaaacatgccctctttagcttataaaatacttataggtagatataggcaaattcacctgacatcatcattgtgttttgcatgaacaataattgactccttacttctatactacgttttaaagacaagaaatgttcgtggtgaaccacagactaattatactctttgcattgcaaaaatagttctttaaacataaatcaatagattaaaaaaatgttttgctaagtaaggcaagcaagaaatatatttagaaagaagtattttggcttcaagtatttaaaacacatctattgtgttaacctgccaatgactcaatcatgttacattctaggtttttaaaaatctgtcattcacattccccccagcaaaactgaagccatgtaggtaagaacagaaaactaagaagcttgttaatagagaggactactcttcaaataagttaaaaataactttgcaagaaaaaaaggatcaccatagtagtatttatataaatttatttaatgcttttgttttgcctgtgagtctgggcatttagaagtcctaacatgttaaagtggaaagggagagcagtctcatctggtctaattccttctttccaaacctgaagcaaaggagttctagagatatggggccatctgcctggagctcactgacaaatccaccagtatcataattctgtttcaagtcaaaatcctcttttaaagaaaccacctgggattttactcccaggaaacaaaattgggatcaaaaccagaaaacaaacagagatacacaaatcaaaacaaaattttgtcactgaaatttttcctgcttcactgtttaatccccagtacttcgtgatggatttatgtcgctcataggaattgcacccggtcagacctgaacaagcttaacctcccagtgagtatacagctttcaaacccacactaaaaagtggggaaaataggtaagaacgaccatcagcattgattcaatagattacatggcattaattacaaagtagtttataaaccaaacactaaatggaagacgtttatatccttaccattagtgatttctgtgtcagaggactcacttgagtttataaaactgtattttaaggctggaatcctaaagtaagatatttctgtaagaacaatcagttagtgtcatagatattagtgtggttgaaagcaattagcaattgatttattttaattataaaaaaattaaaagatcacaaatacaaacaaaacaaagccaagcaaatcaatcttaacataaatattaatgatgtattggatttttaataaagaaatgtaaatagtgaacaaatagcaagctattagatttggaaagataagatttgggaaatgatttattgtagtgtattttatttgtagttgcatcagaaattacattaatcattgattaaattacatttatgattcttacgtgatcaccatatccatttaagagtgagcctattagataaaagccaaagcaattatcttactgattttttgaaataaaaaaatagtaataactcagaaaaaatgagatgcacatgttcttccagcatattttccaggcttaatagagttaaaatacaggccttaatattatcacaatagtgatgaatgtgcctgcttcccaggctagacaatttaggaataagatggctggtgttagtcatctgatcaggtagttaactccatcctcagctggcttttctctttactgacagactgtcacaatgtccattaacaatttcccaaaagcagcatggaaattgataccaagaacactgcaccttcagcctaagaaggtttagatttgagggtattgttttattagtaatccattattcaactgagttatagtcaattcatttttttctctgaatcctgatatataccatttttatatataccttatatatacaccatttttgaaagaaagcaaagcaacttactatcccagttaaaatggctttgttaaaaattacacaaaaaaatagcggcttaaaacaacgagaagatttatttagctcagagatctccagctggagcaaggctcatagaagatagcttgtttctgctccatggttggtagctggggctggtgcaaggctgccctgggaggcaggcagcctcacatctgcctcactgtttttcagggattccacacactccatccagtttcaagaggaatagaaataaactccatgtcttgatggggaatggaaaggcactggaagagcacatggaaacagaaatattactgtggtcatttctggatgatataatttaccacatctgccctctggccactacaacttaatggcagtcttcccacttgcaacactcactcatctgctcttcaaaatttcatctcattattgctcaaggcgaagatccagcacagatgcaggtgtggccaaggcttctcaaaaggcttctcacattggaattcttgagtactgcccctctggtgctgaaagaagctatgagctgaattgcatttcaccaaaattcatacatcacagccctaacccctagtacctcagactgtgactgtattacaagatacggcctttcaaggtgtgattaagattaaatgaggttcttaaagtgggccctaatccaatcagagtggtgtctgacctgaggaaatttggacatacaaaagaatagcaggggtgcacaaacccagggacaggccatgtgaggacacagggagaagcaagccaaggggaggccttgatagaaaccagacctgctgataccttaatcttggacttctagcctccagaactctgagacaatcaatttctgttggttgagccacccagcctgtgttacttttctaatgacagcccagaaaaagaatacagatttgaatcaaagagataagttatccccttctcttctgtaccttttatacaatggtggaacaggcacagaatagacatgacaggccctcctgttcagtaacagggaatgctggagactcacagcaattactagcccatagatattctgaaagctggcaaggtgcatgtctattccttgcctgaggctctgttttagtgcctgcgagtggtccacctgcttcctggctctgccctctaggatcctggctctgccttctagaaccctactctgccctcttgaatctttactctgtcttctgcatttatggccctgccccataaggtcttggctctgcactctgaatcatatttccactgtgccttacctgggaagataaaacatgtaaaacatatgttcctggttcatagggaggtgggtgtattatgcatatgttaaatcaactgccataattgcattaatctccactttatgctcatgattttctaattgatttatcaagatcaaacaaaaaataagcaatgactatagacgtttatcaatttttcagtatattttataccagttttctttttaaaatttcagtgttacattgtgatattcttttatctataaaagtctaaaattcaaattctgaaataatgcttttcctccaagtattctttttggttaatattctcaacctctctttcattttgactgcatttatctgatatcattttcaatgcagttaattttaaccatccttgctttagtttgacagtattattttaccaaatctaatagtgtttaatttcattaactgggtttagttatctctatcggtattatgtgaatatttgatcttctttcattcatgtcttaatttattaacatattatctggcaggatgacgggccataatgaagcaaaatggtattccaactgcccaaatacctatgacttacaggcatacgtcattttattgtgtttcactttattgcatttcaaagatgtttccttatttataaatcaaaggtttgtgacaacagtgcatcaagcaagttaatcaacaccattttcccaacagcatgtgctcatttcctgtctttgtaattgtcatgatatttcaaactatttcgttattattatatctgttatggggatctggaatccgtgatctttgatgttactggtgggattttttcaagtgccacaaactgtgcccgtatcagatggcaaacttaattgattcatgtagtgtgtctgctccaccaaccagccattcctctgtcttgctttctctcctggggcctccgtattccctgagacccaacaatattaaaattaagccaattaataactccacaatggcctcctagtgttcacgttaaaggaagccacgtttctccctttaaatcaaaagctagaaataattaagcttaatgagaaaggcatgtgaaaagctgaaataagctgaaagctaggcctcttgtgccaaacaacaaagttgtgaatgcaaagagaaagattttgaaggaaattaaaaatacttctccagtgaacacacaagaatcttaagaaaatggaagaaccttattgtggatatggagaaagcattagtgatctgtgtagaagatcaaaacagctacaacattcccttaagccaaaacctaattcacagcaaggccctaactctcttcagtaaagagaaggtatggctgaaggccgagagaggtatggaagctgcagaagagaaggttgaagtgagcagaagctggtcatgaggtttaaggaaagaagtcatcttcacaacataaaagtgcagggtaaagcagcaaatgctgatgtagaagctgcagcaagttatccagaagatctaaataagatcattgatgaaggtgggtacaataaataacagattttcaatgtaggcaaaacagccttaaattagaagatgccatttaggactttctcaaatagagaggagaagctaatatctggcttcaaagcttcaaaagacacaggctgactctcttgttaggagctaatgcagcttgtgacttcagttaaaaccaatgcttgtttaccattttttaaatcctagggctcttaagaatcatgctaagtcaactctgcctgtgctcaagaaatgaaaaaacaaatcctgagtagcagcacatttgtttgtagcattatttactgaatatcggaagcccactatttagacccattgctcaaaaataaaacaaaacaaaacattactttcaaaatattactgctcattgacaatgaacttgatcacccaaaagctctgatggaaacctgcaacaggattagcattgttttcatgcctgctaacacagtatctattccgcagtccattagaccaatgagtagttttatctttcaagtccaattatttatgaaatacatttattaatgctacagctgccaagataatgattcctccaatggatctgggaaaagtaagttgaaaaccttctgaaaaggattcaccattctagatgccattaagaacatttatctttttatctcctgagctattctagtggttgatccatagtaggtgttcaactaatatttactcctcattcattcattgcaagaaagtatgacgttatgagtctttcaaggaactttcaattcaattgcatgggtaagacatacgtacttaaatattcacatatatactttaaatagagttgtggggaaataacaaatttccgggtttcccagtgggcctgttaagagcccagccctcatgagtcatgaaaatatatatgatataatgttacaggatgtttgctttcacttccccaagaaacatttttacatactgtaaggttgagatctatagccaatgtttctttaatgatgcagttaattgctctgattgaaaaggatgataaaacttccttcatctccccaaaagccaactgagtacatcctgggataggtacctaggttagttaccaaggaggcagtgagactggagtcttatctctctaagtatttgcatttccaaaagaaatagcaactcagagaacccagagacatctccatgccttacaggtcagaaatgggaatgaggggtggttgagtggttatctggcccttggaaggcatattttcattccagaatgtgaaggtaggatcccaggatgctcctcatcccatctcaacagtgcaactggattctgtccctgcacccacccccactacccgctcctttctggagttggagggaaatgactaatgtatgttatatgtctctctcttacatgtgaatagagaaaatccattttctccatgacttgtgtatagctttccagctactcatataagtcatttgacctggctttaatttggtcaccgcaaggagtaaggtctgaggaaagcaggaccaatgcacttaatatttaatgtaggatgataaatcagaaatcccttccttgattcagaatactttctatgttcattcagaataaaactaataaagatgactatttaaaaccttgcaagcatatgacccataatgaatgtgacaagtaaagtataataacactgtatagacttaagacaagctgttcttacactgatttttccccttctagggaaggaatgtaaacagaaaaggcaaatgctttgtatttccatcatcatgtctattttatggacacaaggtctagtttaagttttgcctttcaataaccctgctgggctgggactttgtaagaagacatttcagtatatactcatacatgcatatgattacaacagcctaccctgtagattttattctaatttaaatctcataataaggattgcttaactgttataagtatgacgtgaaagaagacattttgtatcttcaagaatatgaagaatccccaacattaagaggtttactggccactaagtcaatggacgtactatttgtcttaaccagccaaatatcttactatatgatgaatacattgtccctaggtttcatatgtgaaaagttcacttttgttagaagaataagaaaatattttatgtattcaacacttaacaaattgtctgtggggacctatcatgttttgggaattgtgctaggtgctaagtgatgggagtctacacaggggtaagacataattctgcttcaaagattccatagtctagtaggacaaatttgcaaggaaagttagttttttaatctatatattttctttttttaattatactttaagttctagggtacatgtgcacaatgtgcaggtttgttacagaggtatacatgatctatatattttctatgtttttttaatctctccttattttttcagtgaaattaattttgttgaaaccagacctgtttggcagagtttctcagtttggattttgctagctgcacctctatgttattcttttttttacatatttacattgtctttgtatgttgtgtaaatgagtattcagttctagaggtccagtgagattcaggtctagtgtatgcttgagttttggaaaggcactttgctgtgatgctatgggattctttcataaggcatgccatgttcccttgtccccttgagaagtgacagtgtgctggcagccctcgcagccctcacttgctctcagcacctcctctgcctgggctcccactttggcggcacttgaggagcccttcagccaactgctgcactgtgggagcccctttctgggctggccaaggtaggagccggctccctcagtttgcagggaggtgtggagtgagaggcgcgagccggaaccagggctgcaccgcgtgcttatgggccagctggagttctgggtgggcgtgggcttggcggccccacactcagagcggccagccaggcctgccggccgggcaatgaggggcttagcaccctggccagcggctgcagagggtgcattgggtcccccagcagcgccggctcacgggcgctgtgctcgatttctcgctggtccttagctgcctcctcagggtcagggctctggacctgcagcccgccatgcctgagcctccctgcccccaccccgtgggctcctgtgcagcccgagcctccctgacgagtgccgccccctgctccaccggagcccagtcccaccgaccacccaagggctgaggagtgtgggcgcactgcaggggactggcaggcagctccacctgtggccctggtgcgggatccactgggtgaagccagctgggctcctgagtctggtggggacttcaagaacctttatgtctagctaagggattgtaaatacaccaatgggcactctgtatctagttcaaagtttgcaaacacaccaatcagcaccctgtgtctagctcagggtttgtgaatgcaccaatccacactctatatctagctactctggtggggacttggagaacctttatgtctagctaagggattgtaaatacaccaatcggcactctgtatctagctcaaggtttgtaaacacaccaatcagcaccctgtgtctagctcagggtttgtgaatgcaccaatccacactctgtatctagctactctggtggggacttggagaacctttatgtcaacactctgtatctagctaatctagcagggatgtgaagaacttttgtgtctagctcagggattgtaaacgcaccaatcagcaccctgtcaaaacggaccaatcagctctctgtaaaatggaccaatcagcaggatgtgggtggggccagataagagaatgaaagcaggccgcccaaaccagcagtggcaacccgtaggtccccttggaggctgtggaagctttgttctttcgctctttgcaataaatcttgttggtgctcactctttgggtccacactgcctttaagaactgtaacactcactgcgagggtctgcagcttcattcttgaagtcagtgagaccaagaacccaccaattccggacacacccttacatggtgttggcaggtattggtgatgactacctagacccatttcttattaaggatgcctgtgttgctcttctgattttgtcagttgttctcgtgtattcagtagaattagggtgttggagtttcttctcaagttgtgggagtttcagtgcaaaactggcaaagtcccgaaaaaccaggacaagttgggtactttgatggaacacttctacacacagaacgtcccttcactcaccatttggctacacaggtgtacagtttatacaggaaaggcgctcaagtagttttgacagaaatgatgaatgctacccttggagctttctagataatttgcctttagaaacattgtgtttatctcatttgattaatgtactttctttttatttttacatttttgcttttgatcatgtataatttcctaatggactttagtcaagcattcattgagatgttcttgaaataaataggctactacatggaaatatcacagtaaaacacacatgctggagtaaaaaactgaagagaaaatagtaaaaataagaaaaatatcaacaattctaaaactgcattacaattttaaaactgaggagttacaaagagcagagaacagctgaaagtttccttttcaatatcaggatatgcctggtctgaaaactctggaaaataaattctggagtaattggctgattaaggagattcttaaaaagttgtggctaaagtttgggaagttacttgatgatctttggtaactgggaaataaaactgaatttctgctgaattgggaaaaaatattggttcatatgaattaaaaataaatattgagaacctacaagttaaaagtactgtggtccttgagggaggagaggaaaaggaggaacatatcctgccatagagattttactgcttgtaattcagttgaatattaaaaagatggcacatgaagcataaccatgcttttctttgcaagtgagagtcatgtactcggagaactttgatctgaaacagacttcagtgatcttatttctagagatctcattttaggtattgtgaatcctatacccagaaaggtagacctaccgaaattaactgttaagggtaagtaaaattagataattagcttaagactggaaagcaattttcagaacagagttgaactaatgtgtccctgttttaattgattcttgaggaagggaactttaagtgctttctttgaactcctgggatcccccaggaagcacagttattcaaaacatctgacatcctccttatggtttttggttcgttctttctctttttttttttggacgtagtttcactcttgttgcccaggctggagtgcaatgaagcagtctcggctcactgcaacctccacctcccaggtacaagagattctcctgtcttagcctcccaagtagatcagattacaggcatgcgccaccacacctggctaatttttttatatttagtagaggcgggttttcaccatgttagtcaggctggtcatgaactcctgacctcaggtgatccacccgcctcagctttccaaagtgccaggattacaggtgtataccaggcttttggtcctttctgttctggtaattattcagtatagaagttaagacagctattaaacattttcagaagcagttgaaattctcttgccttgtcctacaatatttaggcttctcagaatgcctttattaaaagaacatttttcaaccattttggaagacagtgtgtcaattccttagggatctagaactagaaataccatttgacccagccatcccattactgggtatatacccaaaggattataaatcatgctgctatagagacacacacacacgtatgtttattgcagcactattcacaatagcaaagacttggaaccaaccctaatgtccctcaatgatagactggattaagaaaatgtggcacatatacaccatggaatactatgcagccataaaaagtgatgagttcatgtcctttgtagggacatggataaagctggaaaccatcattctgagcaaactatcgcaaggacaaaaaaccaaacgccagatgttctcactcatgggtgggaattgatcaatgagaacacatggacacaggaaggggaacatcacacactggggcctgtcatgaggtggggggaggggggagggatagcattaggagatatacctattgtaaatgacgagttaatgggtgcagcacaccaacatggcgcatgtatacatgtgtaacaaacctgaacgtagtgcacatgtaccctagaacttaaagtataataataaaaaaaagaacacttttagcattatcctactcactaaaattagcattgcaaatgtgcaggaatattttagtcttttttttcacaaatgcagaactcaccaatatcatgaaaaataagcatgccaccttgatgataccttgattcaagtcaatattccacttttatgagatatgacaagtgagtttgggctttgctccatacaattcataagtcacatacgtaatgagcatttatttgagctacgttgagcctgtcctgtgtgtggtgtgcttttatgttgtttccccacaatgggccaaggccagaaaccatttcttttcattcatacaaggtcaagttcaaccacaaaacccacactcattatggtagcaggaatggtgctttaaataaaaatgtgaaagagtgaagaattgatcaacgaagactgcaggccatccaggaaggcaagggtgaaggatttattcttcagcaacaaatcacatgcttctaagtgttcagtattttaactggtctcaaaagaatctcatggtgtttcaaaaggactaattgatagtttgtacctggctctcaggtgaggaagagacatgagccctcagcagggagtttccctatctagaaagggcagaccagtgaactattcacttgattatctccaaagcaggactttccatttcagagagctctgtgccttcttgtccatatccagaaagctcagccagcctgttctttctgcattcctgctgatggaaaccccagttgttctttattagctgttactaaaagtcttgactttcccttcatcacaaaggtgtaaaagttacaaacaattctttatgtctggagcaaatagtcacagatctacctttttattaaaaggtgctattgactctgtgcaaactaaagcatggtcaatctttctttaaattagagtctatcaaaaatctttgcaacatcatcacatagagttggaaatactctatgtaaagtatttttttccattttttgtactagattttaggccttttttggtatgggataacattttctatatattgtattatcattgaatcttgcgtgtagtagttaaaattaattagctacaattatgtattgtttcatgttgccctaaaagcaggaaaatcttacatcctgagagctgacattattgtctcttctgttatattagttttttttattgtcttataacaaattaccacaaatgtaatggcttaaaacagcatgtgttattctctctcagtttccacgtgtaaggagtccaagcacagctcaggtgggtctgcaggtcaggatctcacacggctgcagtcaagatgtcagccaggctgtgcttctttctggagcctgggtcttcttccaggctcacgtagctaaggcagaactcagctgcttgcagtggctggactgaattccccattttctttctaactaaaagtaataaaattaaaggtgaaataggcatacagaactgtgtcatctgactgtcttaaattagagcacaaatttgatactactaaatttcctgaaagctgaaggatatagggaaatgtagttagatttgagatgcacgtgtcttttaagaaaagaaaactcaccatccttgagaagcgtgcattgtttcagtcaaggaagcctgagttcggggaggtgtggaaggctattttaaatgcaagtctgtttacttttcactcctacactatttccttaaaacattctgcctgtcagagaattgtagttcaaatattttattttacaaataaagcaactgagaaaaaattaagccaagcagctatgtagtgaaacacttggaaattaaataattaattaattaaataaattaaatagtcattcactgattttttcattaattaaattgccacctccaatcgaaatgacaggcatatatttctaatttatgatatactatgaccagatgttatttactgaaaaatagaaaattgagatttgtaagatctcctaatgttctcctaccacccctgcctaaatttgataattatgttagtatttttgggtgaaatggcacttttaagttgtgaacttctttatatattcaacatgctttactatagaaaggatacatgaaaggcgaaattgatgaaccttttcaggttcaaaaaatatttttgttctgccttaacatttgaatgattggttgaaaatgttttgctccagaactttgaagatgttgtctcagtatcttctgtcatcagttgctgctgctgagaaatgtgatgctcaaaattttaaaatttatgcaagaatcagctgtgggatttgacctaagtctgtgagattcctatggtataagaggaaagaggatttcattttaagacaataaaaccctcatttttagcttcaactatcccaacagtacatttaatctgttcattgagaaagcttctgattctttgctgtgagcttaccgtggcttttagactgagctgattccagtctctgtgtgtgactgattgttctgagcaccagatccttctgagtggcagggagttcgttcacaacaccccatgtaatattgtcacagctcatagtaggctctggctttttctgctgcccaaatcctgtacttcctttttttgtttgtttttgttttttgtctgtctttcagcattttggggatggcccttgcaattctgattttccatccatgtgcagttttaactcggtgggtttgtttttttcaatacatttatgtcagtggggtctatagagggatagaagtcaaatatgtactgagttcaccatcttgacaggagccattcaagtcatttttgccaaacgacttgattcagcttcccagggaaggggttcaagcctctcttaacctgggtttcccatctcccttcaggattcctaatagagaagtatgagtcagggtgcctcacagtactgttgtggacagaaccagggatttagggcccaaaggcaaggttcaatgttgccatagaaataaatggcagtgttctattgagcaaatgctctatactctttgtcttagtccatttgtgctgctataacaaaatatctgaaactaggtaaattgtaaaggacagaaatttatttcatacagttctggagtctgggaagcccaagatcaagatgccggcatccgctgtctggtaaggaagggccttcttgctctgtcctcccatggcagaaagtggaaaggcaaaaagggacaatctctctttttcaagtcctttttttaagggcctctaatcccattcatgaaggaggaaggaggaaccctcatgacctaattacctcttaaaggccccacctcccattatatgggccattcagtttcaacacctgaatttcagagggtacccattcaaaccatagcattttttagtctgattctttatcttcataatgtagaaataactcattgggattcatggagacagattgtacagtgctggactcactgctgcttctcaaaaatccaacaacctcagcgtgacttttgggcctcaatgagctggacatgggttctgtttttccagtcttagggaatgcgtaactggaagggcttcacacttgtgttatatccaaaattgcctttgggccttagcacatgaactttttttctctccctggttggccttccctccgtggtttgcctgagaaactgcccttccttcaggagctggcttcacctccctcctgctcatttcccacgtcagccatactccttggtgtggagttgctccttcccctcagtcaccagggctctgcaaatgaggttgtgcttctccctggggtctccccctccacgactctcagagggcagcagtccagtcttctacatccctgtattcccacagtggggactatcctgccatgtagaagttaatcaacaattgccaagtccaactggatggaaacaaaagaacaggtttacacattgtttctgcgacgtgctttacagtatggttttattatgccactgaggtgatatgaattataaaagcagcagacacagttccaaattaagttcaaaatcacattctaaaatcaatacaagtgtccttggcatgtgggaattattatcactactcttcctgttaccaagatgaatagattttatattatattaacatcattctctgtgcagtaagactggacttcaaaggaaatggaccagccttgatactgaagcaggtttaatgttgtcagcttttgattatccttgtcagcacattcatgtttatctgttttccagaatgactttctcatgtcacctagaatatttctcagtagactgataactgcttagtggtgtgcctttaaagaatataaagtaattttatcttgtgttactttacaaatgatgaaataagcttcataagaaaaaaatactcatgggaggaaatctaatgtcacctgtaaataactgctagatgatcctggccagcatttcttgtcaataatccagatgacagatatttgattgtgtctccgttgagtgcatatgtaattagaagttttatttgttttccctttttgtgtttttttttactatttccttcttattttttaaaaatccaagtcccagcttatccataaagtccctttccagccactctgacataatgtgaatctcttccaaatattgattgtgtcccaccatgtggcaggctctgtgctgggtgctaggaatactgtgctgaacagctgggagcaaggtttctctcgggaacccataggctcttttcagaagcaccttgaactttatcggagtgaaaggtaaagaaacatcaaatagttttgccatacaaatgtactcctggatagttttcagtttgtttgcaagaacgctcacactcctacatctgctcagtattcattagagtaagtttttgtttttaacttcattaactaatggaggatacaagcaaaggtcaggaccaatgagttccatgtgtcctcaggaaaccctgaaggacagcatatgggaaccagtttgatatttggccttgacacactaaaggagaaaatcacataaagtgggatggatggccttggacacaattagtccaggaccgcagttatatttcaatatttcagataagtttgcaatggtttagaccttgaacaattttgactcaataacactatgcacaactttcataacaatttcatttcaagaagtgtctaatgattatctggataattttcataactataaattaccaaatgactgatgaaagtattaaaaaaatttacttttaacagtacagggattaatgctgtaatttttttacagatttcaaatgtagccaataaattagaatcttgtactaagaaaaattaccactttcaatgcagatatggtaatgttttaaggcttgatgaactattcaagttcagaccatcatcaagtgtgacaataaaacactttcatacttgaaattgtcatttcttattgttccatgtaagttaacgcacggtttgatactcctttgtttctcaatgttatgggagacatgcatactggtattctgtgcctgaaaatatggccttgctggcacctagttgctgatcatctaaagacaaatcatactgtgtggcaatgacaggcgacagcaaatgtttctgccttccagaaccagaatattctctgtctccttgtgcctttgctgtcataactgaagctgtcaaccagttctttccttaggtagatgcacataaaaatttcccaaaataggcatgccatttattctgctttgtgctcagtcttcctctgagttcagctccttagtccacaaaaccactccccatgtgacagggtctccacatttaccacatttatgccttatagacttctcagcccacaggcttcactctgtaccctgctgtattcaccagcatgtatttgacatctgaaccaaggctggaatttatcttgctctatacagtctactttctgggactgcccattgtaaaccgctggcatttaagtgtcctgaatttgctggccttgcactataaaacaatataaccctggcttagctccaatttttgcatctctgttttccttgttgttcccaatgtgataatatttttcaataaaatttgctttgagcaagttttgtatcagtgatagcagtaacagtttgaatcttaaggagattttggaaatctgtctaaaatatgccactgacttgacagtgaaaataaatgaaagatactttaaatgcgtgaaagaaattctagttgtctatcagcttctctcaatctcaactctttaaaaatcatctttcagcacaatgtggataaattttaaggtagaaaactttaaggataaagattaatactatttcaaagtatttttctggttctgctttctgtttgcatctttcaatacttatttcacatttaagcttctagttttccattctctttttattttttcactgtgatgcctttctttcttttttccacatgagtgtgttacagatttttctaaccacattagtgcacaactaacttactaaaatcttcatgttaaaaagaaaagaacaagtttcttagaaatgcaggcctttctgtagaagagtgaggataaattaatgagtgactcaattctaattttcagtgaatgggataatcaacacctcttattaactggtctaacagttcatgcagacccacacgagatcagatagatcatcatcactacaaatcattgtgttcctatgatcaaactaaatagtgcttcctaggatcaaactaaattaggcaacaaacttcgcagtgaattacatgtacaaatgggagtgacaatgaaacccacccccatttccaaaatattttcttgatgactagtagtcatgtggattgctcagcatgtattgataatccagttctctatcaacatctggcagatcatgtgttttaaaaatgtttttctttttgggttttcttttgtcttggggaactgtagttataagtcttgccattgtgacctcctagaaagtgtgggtgggttatcactaatatcttctaacacatttaaatacaaccatgcatcacttaaggacagggatacattctgagaaatgtgtcattaggggatcttgctgttgtgccaatatcagtgtatttaccacatacttgggagttataaactatgacacacctacactacatgggatagcctattggtcttaggctacatgcctccacagcacattactatattaaaacttgcaggcaattgtaacagcacagtatttatatctccaaacatatctaaacatggaaaaggtacagtaaaagtatggcataaaagataaaaaatggtacacctatatagagcacttatgatgaatggagcttgcaggactataatttcagtatagaagttgctgtgcacgagtcagtgagtgagtggtaagtgaatatgaaggcctaggacattactatacactactgtagacttttaaatgctggacacaggctacacaaatttatttttaaaatttctttaataaaaaccttatcttactgtaatttttcacttaaacttttaatgatttgctgttttttaactcttttgtaatagcttttagcttaaaacacaaacatttacaactgtacaaaaatattttctttcatatatccttgttctataagcttttttctattttattttttgaattttaacttttttgctttttaaaatagtttgttggaaactaatacccaaagacacatgctagcctaggcctgcacagggtcagaatcatcaatatcactgtcttccacctcctcttgtcccactggaaagtcttcaggggcattaacagccatggaactctcatctcccatggtaatgatgccttcttctgaatacctctggaaggatgtgcctgaagctcttcttgaggaggagtcacatttttagaaatatgtccatgatggtttgcttctttttttcattatagacttgtttataaacaggtaaagcatcataagcattcctctgtattaatgaaaacctttagatgttgggatctatggtttcaaaccttttgtttgcttgtttgtttagagataggatctctctaggctgcccagacgggactcaaagtcgctgggattacaggtgcatgccacaacacccagctcaaacattctaaggagcatcttgaggtctgcagaatcttctgctaaacccttcattgtgaattttttttgggggaggtcactgggcaatagaaatttttcagttcctttataatcttacgggaccacttaacatgaacctaggagttataagctattacacatctaggctacatgagatagtctattgttcttaggctacacacctgtacagcacattactatactaaaacttgaaggtaattgcaacactatagtaagtatttgtatctccaaacatatttcagcatagaaaaatacagtaaaagtgtagtaaaaatatgatacaaaagattaaaaatggcacacctatatagagcactcatgctgagcagagtttgcaggactagaagtggcaatggatgagtcagtgagtgaacatctctatgtagcacctgtctgtgatactttcttgttttcttatttacccccaaatgtgcttcctgccctatgtttccagtgtctttccaattatatttgtatagaaaatcacctcaggactatggattttgtaagccagggaagggcttgctacattttattgtcccctcattgagttcacttctcattctgaccaatgctggatgtcacagtcttgactaattagacccttgactgagaatgaagataaccagtatatcttccagtgcggtaccaaagaaggggacagtagcagtaaacatatacacaaaacaaaacagtgaaattatgttcaataaactaacgctgtagctttgacctggaaaatgaattttttgaggagtaagtcttctaatgagggaagggagaagtattggacacttcaaagaatacttctttaatatctaaagttgattttcctctcatccacttgtaacatgcttcattataaagatagtcttttttttttactaaaaatatataggaatgatttagcactctaattttcttcagatgagcaaactaaatccctttaaaattattccaccaagatcacatagatattaagtagtcactgtaaggctagaatttagtattctctttccctggttatttttactatatggaagctacttatgtttattaggattttaggttagagtcttatgtatagcaggtgataatttatatcaggtgctatgctttgttatatatggtgagttttatgggaagtatactttactctgggtgttaaataaggcttcacaaagacacataagattgatataaatttaaaatgtgaaagcaaaacatgaatgggccatataactatcactgaaatctactgaagatctcatcttccttagtaaacacagacaactgaattgccaatagatgattgccctgtgggaagagaaaggatggaaaatgaaactcatggcctcttcctttctttagccctatcaggacatagcagaacttaaaaaaaagaaagaaattcttattttgtttgttttatatttatttttaaggctaaataatggtctttttttcaaccccagtggtaaagcctagagaaacttctaaccagatttagcgactaaatcatcgacactttagtcaatcttttacctagtcactcaaccaatatttatgaagaaactatcaagtgccaagcatttttccaggagcggaaaataaacaagtatgatccctgccttacctgaatttacatcccctctccataactctttttttgatagtgcaaaggtggtgaatctgggaggtaacagttgtggcctatgtgcaggtagtggcagtggtggccgaaggtgcagagcggggttagagcctgcaagctgatctagggaactgctggtcattgcaatcaggcttttgcctttacaattggactttgtccctgaagcttgtgttggggaaaatcacttcagggtgtgtgtatgtgtgtgtgtgtgtaataacttttagatcctcagttgtgaagtgactagtgaggaaacgagaaattcacagaattgtaagacatattggattttgattatgcataaatattaagcatgtgacatctttttttattagattgaatacaaacacttttttttctgtaagaggacttgcaagttatatgctattatatgtttaagaagatgcagccattttaagagtttttgtaggtctaaataaactcaactgtctctggatacaattcctttggtaagagagatttggagaatctctcataggcatttgaatactggtctacccaaggatagccttctctctaaaggttcacaggactcagaaaaacagtttacctattagattactggcttaacataaaagggtgcaactcagaaaagccagatggcagagatacacgcctcaggcatggaggaaggggtttggagcttcatgccctgcccatatgcaccaatccctgaggccctccctatgacaccaacctggaagctctcagaatccctttgattagggatttttagggaagttccattacatagacaatagatcatatcatcggccattggtgattaattcagtctccagtccctcttgccttcctagaggttggggaattggggttgaaagttccagtcccttaatccatagttcccctggcaagccacacccgctgcttagaggttttctgaaagccactgcaataacataaactcaggtgtggttgaaaggcacttgtcatgaatgatgaaagacactcctttcacctttatcactcttatcacttagcaaattacaagggttttaggcagtctacccaggaacctgggactaagaccaaatacggatttctatgacatcgtaatttcacacacttactgtcatgggctctttttctttctttttctttcatgacggtttatgtatattctgggaataaatagagaaatgggtgagaacaactttagtttatgtgtttttctttaggattctatatcgtatatcttaaaatgcttatatcatagcattttctctgagacataacaccattgcattaattacagcacctctcattattatattggctgtaaaaagggttaatatgaataattcattcatattcaagatcaatacctccatctgctttcctataggccttgaattttcataaaaaatatttaaaaatacattatattcaattatattttactcagcatttttaggtcagcaaactatttcttgttcttttttattgcagtaatcatttaaatcagtttttgacttcttacaaatcacaaaaattaatagtaattatgtgttttggaaaaagctgagtttaaaataatataattttattttttcaaacagaaaaaatcatttaaggctttttgcaaaaccataacaaatgttctttttactactgctactattacaaatgcttccactatccattctcataatttctatttattaagcagttattttgtccttgtgctgagtaccttacatatactacaaatctacttgatttctcaaattttagagttcatgtgagagtcaattaatttccataagtttaattgcttctatatgagtagtcagagaaaaattcgagtggaaaaacaagagatcaaaaagacatctaaaactagatttctagaagttgtattcattgatttttctcttcaatgtctttaatttttgatggtgtcattgtagcttgtgtacaaagagacatggtgagataattactgaaatagacctctaaggcaaaagcaaaccaaatgcagagtgaaaacatggttagatgaatttacttttatgtttgtcatttattaatatagcttttaactccacgtaatatacaaatatgtttatttgaatttgaatatatatacattgactatatgtatttataaactttccctttgaaatttgctagtcaaataataagaaaatttctgatatatctgatctaaagtatttaggaaagaattgtataaaatcaaagattttttttaaatcttgcagaaataaatgtataaatgtttttgttttaattatatctagactatgagcttaggagaatggatacagcaaattgaaattcagttctttggccaatttcctttaaaatttattgtgttcttattacaatagactgattattttatggtatcttcttaattataagtgttgattaagaactcttataaccacaaattacgagtggtaaagacaattgttcttgcttattcattttaaaatgcataaaatattttaaaagcttattagtctgtaattgctaacataaattattttgaaagctttattttgcaaaatgttgcaaaactgcatctagattggattctgggcagctgacataaaagcaattttctaaccatttcctacttttctaaaataaccagttgactgtattttaaacacccaaattaattggcatgcctattattttctaacaaacaatttatcacctgagtatttgaggaatatagaacttttatcatgctatattgaaaatatccagtgaacaagagaatgagaactagagtccatccaaagcatgaaacattgggatctgtgtaataaagtcaacgcacaactataacattgccaagacatgcttgtaggacctctgcatgttagagccagaaaggaacatagctcaatgcttgcagatgactaaatcaatcagtatcaggaactactacatggttgcgcccaagatcacagagtgagtcagcacagaactgcatctttacccaatagcctttttactacgctgtgcagttacgtttaaattggtatttttcaaagtgtagtccttgactatctttatcagaaatcataaccatgtccatgaccatcttaatcagaaattcataacaagcccctttcaaccataaccatgttcatgaaaaattcataatcctgagtttttccctaaatttactgaatcagattgaggtttgggaatgtataatagggatctacattgaaaataagcactatgtaattgattcttccgtactggtttttaaataataatatatgtctatatgattttatatatatattattttgtaataatataggcctatattattttatatatattttatataatatataatatacttactatttgcatatatatgtgaatacatatattttatatataatatagtattatttaagaaccaatatggaagatataatactataataaaatatattatatataatatatataccattatatagtataggcctatattatatatattatagtattttatcttccatattggttcttaaataatactatataatatagtataggtctatactatataatatataatatagtatactataaggacgcaaatagtaaggagtagtaaaatacagatttaaggaatcatctgttttgtctgcatcattggtaagactaacaccatcaaagagatctcaacagcaatagcatggagtcctagaacccaccccagagttgatgataattgttctgatgtgagcataggtgattctaagagaatatttggaaaacattcatttatataatagagtgttgtttcctttaccaagtagatcagcttggtatttaaaattcatagttcatttcttacatgtattctttaaatgttagaaatttgaaactttgattttagtctcttgaccaccaagaagtctaccaaagtctatgacatttcctagttcacaatattagaaagaaaatagtcatataattcattaaattcccacagtaaaattagctaacaccagattaattttatttaattctatgttagaatgctgaattgcagccactaacaaaatatatacattagattttaaccctgcatataaaatttattattttttattttttatgttagtgagagaaatatgtgtttacttacatagtctttcagaatattactatttttgataatgactcagttgaaaatacagcaaaatgtacttactttaacaactgattatactaatgtagaatcatttccaattcttatttgttacattttgctaaagtataaactcattcaatcatgaaactgtatcaggatataatatctagtaattacctgtgattgttaattttttgtgtccacttgaatgtgccactgggtgctcaaatatacttggtcaaccattgtattgtatacacacacacacacacgcacacatgcaccctactggttttgcttctctggaaactcctgagcaacactgcactgattttggtaccaggaagtggactgctgctataactaatacctaaaaatgtggacctggcttggccttggcttgggaactgggcaatagggtagaggttggctgagttttgaggtacagactagaaaaagcccgaatttctacgaagggactattggtagaaacgtggacattaaaggcaattctggtaagggatcgggaggaaaagaggagagctgtagagagggcttcactcttcttagaaaataaataatcatgaataatcaaaatagaatgtttgtggaaatatagacgttaaatattctgagaaggtctcagatggaaatgagaacaggccactgtaagctggaggaaaaatggttcttgttatatagtggcaaatatcttggttgcattttgttccaatgttttgagaaaaatagcacttataagtgatacacttggctatttaccagatacaatttttaagcaaagtgttgaaagtatggcttgggtcctccttaaggcaatacaataggaaaaatatggattaaagaaggatttgttaagcaaaaagacccaggacaaggagatttagaaatttctcagcttatctataatgcaaaaactggagaagtctgttctggagacaacactaagagtgcaactgaatcaccctttgctaaagagataatgggggtgacccatcagcttaatcagccatatcagcagaagccaggaacagcaaatggattacaccatcaaagatccggcccgtttgaactgaagaggatagggggagcaggacagattaaggaaaagctgtcagacttcttggattctataggaccgtctggtcctatagaatccatagagctgttaaccaaatggttggggttgtcctacaccctccttaacaggatatggaaacaaagaggttcttcttcagacttcagatttaatgaaattgcccttgctaggttttctgctttcatgggaatcatcacttccttttttaatttagatttttccattttgaaaagaaaatatctatcctatgcctctcccattattgtattttggagacacataacttgtccgtttcacaggctcagcgctggaggggaattttggctcatgatgaattgtacctcaagtctcattcatatcttagttagatgattttagtatgagactttggcctttaacctttagagttaatgctggaataagttaagaatttgggggctactggaatgggatgaatgtattttgcatgtgataagaacatggatttgggggaaccaagggaagaattctatgagctgaactgtgatgtccttccaaaatgcatatattgaagccctaacccctaatgtgactgtatttcatggtagggactttgggaggtatcaaagtgaaatgatgccataagaatagcatcttcatttcataatattggtgtcctttaagaaaagaaaaagaggctgggcacggtggctaacgcctgtaatcccagcaacttgggaggccaaggcaggtggatcacatgaggttgagagttcgagacgagcctgaccaacatggggaaaccccatctctactgaaaatacaaaattagccaggggtggtagtgcatgcctgtaatcccagctacttgggaggctgaggcaggaaaatcgcttgaacccaggaggcagaggttgcagtgagctaagattgcatcattgcaccccagcctgggcaacaagagcaaaactccgtcccaaaaagaaaaaaaaaaaagaaaagaaacagaaaccagagctagctcattatctaccaagtgaggacacagccagaaggttgctgtctgcaagccaggaagagagaccacaccagaaaccaaagcccactggaacttgatcttggacttccagcctccagaactgtgagtgatacatttttgttgttttcttcacccagtttatggtatttattatggcagcccaaactgactcgatgccaagtgtcattctagggaaagagacttttaagaatgaattttctgagttggttctgaagtatctggaattggctctttaatctgattgggtttaaagatgccaatgactctatttctaatattccatggtgtctatattccatggtgtgatctggccatagagatatgcagaatatcaccattggacactcctaatcaaccatttataagaagcaaggatctgagtactatgtatatacatttgagcatttttggcaaactaatgaatataatgagattggctggcagctcctaactcactgcacaaagtgagaaaataaaaggatgagttcaggaattcaaattccaagctcaagggctacataaatgacatgaaagattctgggcgtgctatgaaggagctcttttttcctgtagccataaggctgagattgttaaaaatcaggtgcagaataccactctgcgactggctgaatcaaaatgcaacttgaactcccagcctgttgaactatctgctacagtgagggcattgattggtaaggaatgggatcttgaaagtcagaatgggaacgaccctgtgggaagaccctgatgagtatgggcacaatgagccagtaaattggaatgactcatttttgccagtagaggaggcttctccattttcagtggagagtaggagcagcgctccattttcagggcttcagtgggagcagcctccccacctgcaatgatagtagtctcctcgccctttcacccctgtctgaaggacttaaccttacattgcctgaaaaacctataatggcctccccaaaggcagttactaggcaaggtaatgccatttctctccagagccatccccacctccgctcctttcttccagacctataactagacccaagtcccagaagtcccctgaaggtgaagtacaaagtatgacccatgaggaggtgcactacactccacaagcacttgaattttctaatttatacaagcagaattccgaggaatatatatgtgaatggatactaagagtatggattaagaatgaaaggaaaataaaagttggatcaggccgaatttattgctatgatctccctaagctgagattctattagggaggattttaataatttgtttaataggataataattttttgataggataattgaaacatgaacttaaatgtggcctaatgtgaccaagttagaaatgctagactggcctttggaggcttctataggtgaaccacagcatgggtctttatgattttggagaaaagcccagccattcactcaagataactattttcttttgagaatcagctattggcctactactggatctcagaaaagactgaatgcttaaccattggtcaccacgttattatgtggcgtgagctgcccatcattaactggatgttatctgactcactaagccataaagtcgggtgtgcacagcagtactccatcatccaataaataagtcatcaggcctcagcaagccctgaaggcaaaaataagtcacatgaactagtggcccaaattcccatggaccccattccagctaccatggcttctccctcccagcatattcatatggctcctgccaagttcactgtgatcagttggcagggaaagagaagtctctaacctggtgtgcagatgattctgatgttgttgggtgaagtgttcagtatatgtttattaagtcacattggtgtagagtgttgttcagcccctttgttttcttattgattctctgtctcactgacctaccactactaaaaaggcaattttttaggtcttttactattattgtgttaatatctatttctaacataaattctgtcaaggttttattcatatatttgagtgctctaatgttagctgcctatatatttataattattacatcacatcttcctggtgaattgacccttttatcgttacatcatgtcctacttcgtgtcttctgaccatttttaacttaaaatcaattttgtgtaagtatagctacccctgctccctttggctaccatttgtctagagtatcttttcctatttttttactgtcaggcttatatcaaaaaataaatctcctgtagacggcatgtagttggatcttgttttttaatccattcagccactctgtcttttgattagggagtttaatccacttacatttacagtaattactaataggaaagaacttaccattgccatttcgttattgtttttgtgtgtcttatagttatttcattactttttatttctcaactcttttcatttttcatccttttttatttttcatttatagttatcttatcccatgtcaacttttcctctctagctgctttcatttgtgtttcattgatctttctctgtgtgtgtgtgtgtgtggtggcatgctttgattcctttgccattttattttatgcatcttctatagttattttttttcgggttaccatggatctaacataaaatatcttatataatatattttaaattgataacaacttaacttcaattacttacaaaacctactcctttacatctcttcctgtttcttgtccccatgtacataccatatattgttacgctagtgtctctgtggtagaagaagttctggtatttcctattctgccatcttcctgatactttgcatctttctttatttaaaatgggcaaatatgcattttaattattacttcctattatgtataagtcacatactcaagagatggtcataatttaactttatataattttattaaatgtctgctgtgtgtcaagctcattgagaagctctggggattccaagaaatgaaagatacagctctgacattatgtaacaggatgggatgacaaataggaagaaaaaatcattaaaatccagtgtaaggatttcaataatgaaactcagtacgcagtgcagtctgaatagttgtttgtctctgtggagtcagatagtatatcccaagaaactgcatgccgggttgaattttaggaagtagactggatttcgtatacaaaaaataacctcaccattttgaactgaagagtttccaagagacagttggtaaacaaaacacctgctttagaagttatctgtgttatactgaaaaatattttctgtgtctctccatctgtccaagcagtataactatatttaaacatttagctattctgcatgtatataactgcattttacccactgactaaagaaattatctacagagaacagagggaggcaaaaatcaccaatgtaagtaaaaatttttccatgtgttaattacaaatcattccaatgtagcacttggtaaattctgttttgtaaagttttaatttttgtttatttgcttcataaagataaacaaattgtaattctttttggttagtgattattaaactcccagatcctcttatttaaggaatgcaaatatgttttcacgaaatacagaagttaatttaatgttatgagctcaaatatggtaggtcactgtttaaattgttgagtaaatctcacttgttaagtctagtgatcaggattttttcaaacagctctccatattaatttttcaagtgtgacaagagaattctaaattaattcttggtgatgtgtaagattgtataatgttaccatgtgattaaatggatatacatacctttgtaaaagtttattaagtagtaaaaaatgtacaatatgtgcctcagtttcctcaacctcacaatagataactatttttcaggattgttctgatgacagggaaacagtagatgggaaactcatttaagaagtgcagagtttaatctcacatgacagcttatacttttcattatggttaaatgtatattggaagatatatttgaagatatcaatatacttgcagctaaatattattttttctctaaagtgagatgttcttaattccatatctgttcatggtgacaataactgtgaagtcacctgggctatgttaaggctgactccacacctgttcgcatgccttagcattgtttgatcaccaggcccttttgtccaaggctcccaccaacacctttactccactgtgaatcctcgttcctgggccattacaggaatcatctcactcctcttacagattctagtcctgggatctctgatgtagcctacacaatttttttttatggatttaaatttatcttccccaaaattcatatgttgaagctatgtattagtgttgaaatgcttagcttgttagaagacctattttgatggtgaaggaccctgaacaaaacacatagccaatggcattctgccacaattttcactgtcttttaggtgtttgtgacctctctgtttgctgttaaaatcttaaattccctttaggcaaatcttcctggtgaattgacccttttagccttgctaatagtgtgatcaattgtagtttccttaatatgtaaacatccaattagttaaaatatcaaggttgctatttttggagtcctggaagaaagagcataataactaagtaaattctgtttaataaaactatataggcactttcgaatttagtcaatatcattcctgttactattttgtgaggtccagagactaatctcccttgcaggttgtaatgcatggtacatttttatatgggcagctcaactgttgtaaggcgcacaaaagatcttcattttctgtcctttctgttttcagcctcttcccagaccaggtacccagttcatagggacaattgggactgtagtaattagttagcttggtggtctttaaactttgctccgcagagctccaggcttcaagaagagtggcctaattttcactggaaaataaagtgaacttaagaaacctcagccttttttcatgcccaaatcaatgtgaactgctcagcatttatgtgtttttcatatttggcttctacacagcatttagatgaaacaaggcatctcatagctaaataaataaataaaattccctaggcaatttgatccttttttttagatcaaattggaagttggaaaactgttttaagttggaaacttgttttcacataaataaaaatgttttcatcgtgaagaaagaaagtcacaaactcactacctcaggcactgggaagtaaaattaaaaagtgaaggtgtaatgtgtcctggataaggaagaacttgctatccattaattgcagagtgaatgtctgccagagtaacatttaaacaacatgtgtctgcaggctagatttggtccttggtttgctgttggggatctctcctgtagaagattcttgaacatgcagggcaaaatagtgtgtttttaaacaacatcatttctgaaactctatgcatgctccttataaaatgagatgtttgcattactgacttttgtggacatagagccttgaatctatactctaatgtcatcagatggccttcaggcacatggttgggcacattagattctggtggatctggctggtgtgctggggcaatgggacatgcacaggaggacctgggggacaagctccagaactctacagagagccaagagtttgtacatggaacagatacgacttacagaggagccaagcagaagagacagtgattcagaagggctaaggtaaagaatcaagggcatggcagctgtgggaggggtgctgagcaattgtgagcatgagtgtgaatgaggtgagagtagatactccaggcagagggaaatgtttaggctgaatcacttaaaaaacatgtagtgtcaactttacaatcctagcctgtgcttgtttggggatattattcccatgtaaaaggagtcaggataagataagtcacaaaatcctctgataatacgatgaacatttggaattttatattactatgtggggaaaaatagtaaccctataggtccttggttggaattgacccccataacaaaagacagattaacaagagaaaaacaaacagaagtttattacatgtatgttttatatatgcatgggaggcacccagggaaggagtagctctgcaaggggagactttgagctccaggttatatagcaactttacgaagaacagtacatttttagagaagtgacaagaaaaaggaaaaggactttgaatctctatagatggcaattcaggggaaaggcaaataaatggtgaaggccggttagtaaaggtgttatctccaggctgaaagtctaaagatatttccagtgggtaaactttgttctcactggtagaaggagaaggcagggtatcttttgtctttgtaaatttacatcctacttttaggcaaatagagggagaaaaaagagctttcctgcgtctgctgcaccataattgtcttcagctcaacaaaccttcctatttgggggcaacatattctgatttccaacaactgtaactatacagattatacacatcctccacttcatatttataacaaaattggcaattactaaaacttgaaccagactcttgctattcagatttgaggtttacatgtcccagaatgggtaaaatattttcatatcatcttactgaggttttctttgcagcagtagtatttttcacttgcataatgataataattttgtgaaaaaaaatattacatctgcctattacctcatccttgaggaaaagtcagtgatgtatcattggataggaaaagggtattgagactcagatcgtttaagcaaatgattcagcaagtaagtaacccagccaatggtgaagcctcctgacttgcagcctgacacttaccatactgtgtcgtccactttcagagtcttcatcaaattgtatatattttttgcctgcttccatgaatcccaggacttcattttaatctatttcagaagtagattaaatatataatattatatatttaatattaataaattatatatatatatatatatatatatatagagagagagagagagagagagagagagaatagtgcttccccaagggtttgaaaacaatattaccttgccctgaagctctcctcatcttcaccttcttttgtcagttacacactttgatcagttgtcttgtgctctttacatgctgcatttagaacttcttttatcctcaagcctgaaagctaaaacttctggaaggtcaaaaggaagcagtgaaggattcaacctggcctgagtgttcccagactccggctcctgcctgggcatcatgagcccaggctcacaatgggtcggctttctgagtcagcttcataaaataataagcacatagaaaggaggctgctcttggggaattcgggaggtgtgtatttgaggagggtgagaaggacaattgaggtgaaattttgatgtaagtgagtttggctgaatttttgaaatggtaaaatctaggcactcaaaagcctgcaccttcataaattaaactttaggaaaggaagaaaaaaaatggaatgtgtagggacatgaatatttatacccatttatatatcctttgttggcttatttctgtgcacatgggaaagtttaacaacttcgtacataatttcaagttctttattcattttttagatttgaaggaggagaacaattttgcaaaatagggtattcttcagttttttggaaaacgttttatgtttcttaaaacatctcatttgttttttttctaattcactcttcactgtgtttgcagtacttttctggaaatgtattcatgaattttcagaattttttctcctctaagtgaagaatcaatggttgaaaagactttttttatagcatattatcaaatttgcataattaaaaataaatatacacacaaaaatgtcaaaaatctagctaaattgattggttaaaagcaattttatcatataaagcaaaatcacctaaagaattgacataattgcctaatattaatttaagaattataaaatcaacttagacatttgaagcccacataaaatatcaaaatgtccatgagactgcagttattttgatttttaaaaaaattgattttggaatgttcctcaggggtgaacagaaaatttcaaaacttcatgacaactttgtgaaaaagcagagtaggtataactggtcaaaactgagttaatatcaataataatgctatgggatgcttgaggtgtcgcttttccggatggaaacctctgtggctggtggcacctttgcccgagttttgctcaggtccactgggctcgttccgcccactcggcctggcaggctgtgcttggctcatgctaccagcctggatctcatgcctgccagggcaagtcatgcatgaagtggcaaggggtgtgtgagtgagcacggggttcggccactgcacgatcagacacaccaactgctgcagtggggagggtggctccaggtgctggcatgagcaacagctctctgtgaggctgtgtcttgtccaggtgcacttcaagcagctcccacaggtggcattgcagaacacagtggcacccagaagtttggagatgccaggaaccacagggccccaaagatggtgtcacagccctggctcagggagttcacagatctgggaatactgaagggccacagctcttccctccttctcttcgcctgcaacatgatgagcaaggggcatgtttcagccctgctggtgttacagctgttttagccctgccagttgatagatcctgagttcttgtgctgtgaccaggaaaaatgaggtgtgcagacaagtggagggtgagcaagacaaagaggagctttattgatagataggacagctcagaggaaagccacagcaggtagctcctttcttcaggcaggatatcccaatgagtgttcagctcttagcagagaaggtagctcctctctgctaggcaaatcatcctgatgagtgctcagctctcagcagagagggtagctcctctctgcagacaggttgtcccaagaagtgttcagttctcagcagagagggtagctcctctctgcagctggtcatcctggcacctgctcagctttggctgatcctagggcttttacgggcctcagaggggagaaagggcatgtgattagtccatgggagccataggtaggcccagaaaaggcaccacaagctcccactctggtcagcaggactgacagcctgtcccccagccttcaggccctccctgccctgaaggtggagccttaccagggtcttgccccctttcacccaggaacctgtctgcattctgcagctgttcatggagcccaggctgtaggtaccaaggggcacctgcaggctagtgaagaactgccctcaaccccacctcagcttcccttctgtgctagttggtgccccaagtctggaggcagctgaagtggcaaagggctggtgtggcagcattgccttgagcatgtgaacagctgggtgggcttcgacggcatctgggcttggccccgactttgctccgagatcagagtaagtgctcacagcagggagtagccaggcagcaggagtaggcacttcctagcctatgaaagcagggggggccttcatgggcccccagagatgccttggtttacagccacagccatggcttcacagctgcagttgggcagctgcagttgtgccgatggggggtcaggggcagggctccctcctgctccagggcccaggagcacagggatgtctggatccacagctatgcattgggtgactgcagcagcatgtggggagctcccaccccaactttgaaggggcagagctcccactttttcctggctcccaccactccatggagcatgcagccatggctgcacctctcttctgcagctgacctgatggcaactgccgctccagacagcctgctgctgccaacagtaataataataaatgttaaaagtgcataaaacatctcagtaatcccaaggactacagaaactctcttaaaaggactctttcacacaggtgaaagttacaaggtgcaagagcaacttcggaaaatgcctggcggccatccctgttctccagcatgtgttagctggtcacagggctgcccccttaaacaccacatttcccagtcccagcatggctagatgtgatcttgtaatgagagaatggaatgtgaatgggcttgatgtgtccagctcccattttctgcctggcaggagcttggacatgagggcagcaatgaactcttgtcagagcacacatgctgaggatggcagagaaattggagggatggagagtgggtcccacagattttgaaatcacctcgggacgtttacgtttggactcttacaagagaagcaaactgctctctgagttatgccactattatattgattttttaaaagaaaccagtatcctaactaacataaaaaggttaaagatgcttaaatagttgactccaaggtacatattgttaaatgaacaaaaaattcacacaaaatgaaactcaagtgactgtaaccattgttttaaatcctattgttgtaactgagtttggagagaggaccaattaatatttttccaacagtcaaggcataacctgaagatgtgaatgtgtgtggagagggtacacactgggtttcagtttgggacacacaaagagataggagataaattttgcatatttcattattttgcctagagcaaactctataaatagataacatttttctcttcagtaaactgaactgtcagagtaagcagaacattatagagactttttaacactcatcaagtaaagcattatggaaattatcaaaatcatttaaatccaaaatatttttgcaccaatacttcctattctgttttacataactacttagctctccatgggtgcagctggagaggtgcatatctttatcagtctcctgggcaatggagcatttgaagggaagcagtcttatgttttatattcagcatgcataaatttggctgtgtttgtctcattttattttccaggttttggttgcaaagatgaagtttaatcaacagctattgttgctgttcttatcataattgatgataataattctttttaatttctgagtgttagatttaatcataataggcaagatctctagacagaggccacatctgatgatgtgacagtcaggaaatgttcagcttcactttcacttttcttggtcaggaaccaggctgttaccattgtttgttaggtcagtgacgtaataatagtctagacaggcttccttaggctagagctttccatgctttgtggcttatcactgagctgtccatggagattctacatggatcaaagatgaggtaggggacattcatatattgtcattttttaaacattaaagatgatttcatcacattatatgcattgcagttctcatctccatattttaggtaataaagtttactgatgaaattttaaaaattattttcataggggctttttttttgcccctagaaaaacttatgctagataatgattaaccaataaacttatttttcttttatccatggatacagaaaagaagacatttataaactatgtaattgttcctgcatcatattttagtacaaatcaattacttttaaaaaatcatatacagaaagcattaaaaatttcatatctgaataagaaaaaaagtaatatgggaagatgaatgtgtctccagagaaaaataagttttgttgttggaaaaaaaatctaaagtttacattttaaataacagaattagttaacctattgtattagtcagggttctctagagggacagaactaataggatatgtgtgtgtgtgtgtgtgtgtgtgtgtgtgtgtgtatatatatatatatctcctattagttatatatatatatcctattagttatatatatatatatatatcctattagttatatatatataggatatatatatcctattagttatatatatatataggatatatatatcctattagttatatatatataggatatatatatcctattagttatatatataggatatatatatatatcctattagttctgtagctatatatataacatatatatatattatatatatatatatatgaaggggagtttattaagtattaactcacacaatcataacgtcccacaataggctgtctgcaaactgaggattaaagaaaccagtctgagtcccaaaaactgaagaacctggagtctgatgtctgagggcaggaagcatccagcacaggagaaagatgtaagctgggaggctaggccggcctcgtcttttcacatttctctgcctcctttttatattctagccatgctggcagctgatcagatggtgcccacccagattaagggtggttctgactttcccagcccagtgattcaaatgttaatcttggcaaaatcctcacagatgcacccaggatcaatactttgtatccctcaatccaataaagttgatactgagtattaaccatcatatctatgttactaataaaccagctacaaatgaagtgttttccttatagtttttatagtataacatagaaatatctagtatatattatattctggaacttatcatgttattaaatggctggcacttgttagttgtgtttaaaggattttcaggaatatctagaaatatgcgctactagagttatttggatacaagagacgaaatccaaatatgactagctcaaactataaaataattttttggaaaaatatggactgtttcaccaaagtgaagaagcaactgaccaactaggctttggaaagagcaggaagtagggtagctcacggaatccagataatgggactgattgacagtatttttttctagataatatcatcaaaataaactactttcaatatttcaatttttttaaaaaagaaatatgctcttttagtcaattattatcacaaaatattacacaataaaacaataaaatctcagtggcatacacaactgtatcagtcaggattctccggaccagctgaagcagtagaatatctatgtatgtgtacacatattttaagagacccatttaaagaaattggctcatgcaattgtgtgggctggcaagtccaaattctgtagggtaggctggcagaatggaaactcttgggcaggagttggtgctgcctactcgaaacagaatttctttatcagagaaacctcaatgtttgcttttagggcctttcagtgattgcatgaggaccacccacattattgggaataatctcctgtacttaaagccaactgatttcagatgttaaccacattaaaatacctccacagcaacacttagattaatgcgcaattaaataattgggcaccataacctattcaagttgacacataaaagtaaccatcacagctcaccctttgtcaacgtaacattcatatatatccccttaaacctactttagctccaaataaaaaccatcacaaagtcatccttctaacgaatatgatacaacagtcctttgtataatcaaaaacacactaattatttccctagaaggggatacaaaggccttgagtaatctccttgatatgctgtaatttaaatgctgtgatgtaaaattaactattattaataaatcttatgttagatgataagggaataaagaagggaagaaaacaaagataattgacatatattatacatatgtgtatacacacatatatatgtttgtaagtgtacatgcacatacagtcaagtttataacaaaatgagaaagaaataacaattacagtcctcatttttgcagctgatcatgtggtggtagttggtagtaataaccgcctttttccactacccattccttattccttgtgtcctcagcaaacacctcagctggtcatagttcttcacctggtaaggtaacccaaatcttcattcctgaagtgtctgggccattaatagtccctgcctgaacggggttattgcagttttccattggcatgaatcacaagcatggtaagacacacctaaggaacctcctgtgcatactcttcctgacctccaagctggagcagcccaatttccctctggaagtcagtatcaatcaccccagtcagaggagtaactcatttctttgcatgttgattcagaggcaatggagtccaaagtggctgggagtatctcaacttccaattcaatgaaatcattgttggatctcctaatagaaacattcttcactgtggaatgaagacctctaaaccagaagagaataaggtcgcaggtacaggaaacaaaagttttgctagtaagtagagagtaatactgagaggcactaccctcatttcctaaactcatgaattctggtaatgggagagacagcaccatatattgaacatatacagcttcctggagaactttgactcagccctgcaagaaaatgccacctggctgatgccataactgttttcaaaaggccattgcactgctctatcaagccaacttcaagatggtgggaaaatggtaagaccagcccagtgaaatttatgagcatggactcactgcttcacttcattttctgtgaggtgagtgccttgatcagaagaaatggtgtatggaatatgatgacagttaataaggcattctgtaaatccacaaatggcaattttagcaagaacgctgtgtataggaaaggcaaattcatatccaaaataaatgtctatttcaataagcacaacatgctgacctttccatgatgtaagtgtggcccaatacaataaacctgccatcaggtacctggcttatcactctggggaattatgccatactgggctcagtgttggtctatgctgctgacaaattgggcactcagcagtggctgtaaccatgttggccttggtgagtggaagtccatgttgcacctgcatattgtgcagaaccatctctaacccaagtcaacttttctcttcctccagtgaattgtggttaggaaactccccatgagaccataggtgtgggctaagagaaagaaggtaatggagcaagagtggaaaccatagataattgaagttctttctcttgtaaactatttgtgccttagggtctgcttgagcccgatcacttccatttgatgatgtgtacccctaattttatggcttggtctattggatgatacccagttcatgatgaacatctcaggtgacttggtgtcccatggttaatcattctgtatctactaatagccaatagcagaaaaagagctgtctcttaaaagggagttgttatccagagaagaaagcagggattagctcccaaattctgaggacttgtcctgtgattcacctacagggacatgccaaaggctctaaacagcatccctgtctgccactgccacttcacatgacagatattctgcgtcatatgttccaagtggtagagcggcttgcacagtagcctggacctgacgcagaatcttctcctgttctggaccccacttgaaatcagcagctttttgagtcacttctctaaagaggccatagtagtccacccaaatgaggaatatgttgcctccaaaactcaaataggcctcctaggcattgtccctcttttctggtcataagcaaggccaactgcaacaacctattctttaccttagaagggtatctcaactgacatcacaccactggacccccagaaactttgctgaggtagaaggtccttgaatttttgtcagatttatttcccactttctgacacacaaatgtcttgttaataagcctagaatagttcctaattctcacttactaggtccaattaacttaatgccatcactgtaatgagccactgtggaatcttgtggaaaggggaagtgattcaaaatccttgtgagctattgacatagggctgaagattgatacatctctgaggtaggacagtgagggtatattgctgtcctggccagctgaaagcaaactgcttctgatgggccttatggacaggaatggagaaaaagggatttggcaggtcaatagctgcatgccaggtaccaagggatatgttcatttgctcaagcaataaaaccacatctgctacagagcttcaattagagtcaccacctggctaagcttgtggtaatccattgtcagtctccaaaatccatctgtcttctgcataggccaagtaggtcagttgaattgggatatagtgggaatcacttctcctgaaacttttgagtcctcgatgatagtaataaagtctacaatatctcgaggaaagtggtattgttcttggtttgctattttacttgcaaaggtaagttaaaggtagttctaatggcatccatttggcctttcccatagcaacagctctcactccacatgtcagaaaaccaatgtggtgattctgctagttactgagcaagtcaattctaattacacactcagaaccaggggaaaaacatacaatgtgttcacagactaccttggccttaccctgagatggacttgagctaaaactccgctggttacttccacagcccctcttctgattggtggaccacagtggtgttttgtgtctccaggaattagtgtcatttcagaaccagtgtctggtagttgctgaaagatatggttttttcccttctttaattcatatttagttcacatttatttgccctggtaaaagattctgcaattctttgggggaggctgggagcaagattaacaacatacacctgtggtagggtatcagcgtccttctttatgtggcccgacttcctttctttattagttcatttgtattgctataaaggaatacctcaagcaggctaatttataaagaaaaggggcttactttgactcatggttctgcaggctgtgcaagaagcatgacaccagagtctacatatgctgaggtcccaggaagcttttagtcacagcagatggaaggggagccagcatgtcatgtggtaagagaggaagcaagagagaaagaagggaggttccagactcttttaaacagccaggtctggcatgaacttattactacagggaggacaccaaggcattcatgagtgatctgcctccataacacaaacactctccaccgggcccaccttccacactagggatcccatttcaacatgagatttggagtggacgaacattcaaaccttcatgcaaggggctctggttctacaaaccatttcaattctgggaactgagtgagagtctatgactctattctggtgattcatactagaattttcactcaacctagaattcatttgcttgtactgatcaaataaaaatttagtaggcttcctgtctattttgcttctagggacacatgatcaacttgccaacaccataggcctctccgagttaagctactctgattactgccttggccctgatttccattctcataaccatggcctctttgtctttgccacttgggccctgtcatcccaggatccaattactgccattgcatgtaaggattccagttcagtggcaatagttcctatggtaatttctgccctacagagaagagtgcccgaagagctctttaacagagccaccacacaaatttcttcctcagagtcaagtcgaaaggtgcattctctgggccctcccagggtcagtgaggggctcttgtatgataaatccactctaacattccagtactcttaagtcatctgttaacttcctctgcagtgtaccaaggcgatcctggcattttaatgtaatttattataagtcatttttttttggtccatgtttaaacccaagtcaactaaacaaactgtcagaatcctttctaacaccccaaatttacatccagaatttatgcttagtggggcaatatcaatcaatttgacctagtccaaatttatgtgccttccaacattatccaaaatcatgagtatccattccacacgtatttcccagaagtctgtctgtataaattgaaaaaatatgcaatgattttgaagtggaacacacgtttaatgggttaaactttgtatctcaccttttttcacctgttgccacttgagtgtacttatacctataaaagaaaagagggttggtggggttggatcctcaggagaatcagcattgtttttaggacaaccacctcagtgaaggctatcactctaccaccaaagaagactcagcagaacttaggggttcactgagctcagcttcatcacagacttcatatatgtcttccttccaatattcagggtcctgtttttcccaatcaacgtctgtgtttaacagaagaaactttgctaagctggggtttaatttgtaatgtaattcagtgactagcaggatgagactctgggtttagtgttcagaaatctcaggctcatggctataggagataagggtataatctaagacaggcatatgcattttcaggtcatatatgcagggcataggctagtaatttgaaatcctaggctcaccctttttctctctactttctataccatggttaagagcaaacaaccaatcttattgcactcattatttgacagaactgttctaagttatcaaatacttggtcactgagaaccttgccttatcaatacttgagtagtagtattcagtggtgatattgtgtgtatctctattgcctctttgtgccatggactaccagtgttcttgttaatactggaaatagagtctttactgcctttaaatctaattagattacagaatcaattcctgaaaccccaaaaccaagtcaaaaaactcattcttagaattctgtgcctttaaaaccactgttggtacccaaatctatatcagtcatggttctacagaggaatggaatcactgtgtatatgactaacatgaatgggattcagcaagtctaaaatctacatcagcccagcaggctggaaactctcatgcagaagctgatgatgcagtctggaggcagaatttcttctacagaggaaactcatgcttgcttctgaggctgttcaacttatttgatgagacccacccacattattgaaaatagtctccattatttaaagtgagttgattatatatatcatctgcaaagaaacttcacagcaccacctagattagtgtttgattaaatggctgggctctgtagcagctaaagctcaccaccacaaatatcaagcacttatttgacgcaggagtcttcaatgtgattgtggcagctctgtcctgggcagggatgtaagggtggttgggatgaatcttgcattctgtgggtcatataagaagtttggctctgtgtgtgtcactttaaggccaggccaacagggcagcagcttcttggggaaactgttctcgtgcaattgcagaagtgctagagggcacgggaagcatgtgaggcctgtagagaaactagcatatggtcatttctccccacccatagctggagtagacataagtaattttgataataagtgcagtctatatgaatgaacgtaaaataaactatgctgtagtggatacagttgtttcccacaggcctgtgggttagcatttcttatggctatacatgtatactgggattgcacaactgagcacatgaatgattggttattggaaactatgtttctcactgtcagagacttatccagtggaaatacttaatcgattgtatgacatgttcagtttctactaaaaatgaacaatctatttcctttcacagccaacaggccctggtgtgtgacgttccccttcctgtgtccaagtgttctcattgttggcttggttcgaagtctttgctattgtaaataatgccacaataaacatacgtgtgcatgtgtctttatagcagcatgatttataatcctttgggtatatacccagtaatgggatggctgggtcaaatggtatttctagttctagatccctgaggaattgacacactgtcttccacaatggttgaactagtttacagtcccaccaacactgtaaaagtgttcctatttctccacatcctctccagcacctgttgtttcctgactttttaatgatcgccattctaactggttcaagatgatatctcattgtggttttgattttcatttctctgatggccagtgatgatgagcattttttcatgtgccttttggctgcataaatgtcttcttttgagaagcatctgttcatatccttcgcccacttgttgatggggttgtttgtattttcttgtaaatttgtttgagttctttgtaggttctggatattagccctttgtcagatgagtagattgcaaaaattttctcccattctctaggttgtctgttcactctgatggtagtttcttttgctgtgcagaagctctttactttaattagatcccatttgtcaattttggcttttgttgccattgcttttggtgttttagatatgaagtccttgtccatgcctatgtcctgaatggtattgcctaggttttcttctagggtttttatagttttaggtctaacatttaagtctttaatccatcttgaattaatttttgtataaggtataaggaagggatccattttcagctttctacatatagctagccagttttcccaacaccatttattaaatagggaatcgtttccccattttttgtcaaagatcagatagttgtagatgtgtggtattatttctgagggctctgttctgatccattggtctatatctctgttttggtaccagtaccatgctgttttagttactgtaactttgtagtatagtttgaagtcaggtagcttgatgcctccagctttgttcttttggcttaggattgacttggcaatgctggctcttgtttgcttccatatgaacttcaaagtagtttttcccaaattctgtgaagaaattcattggtagcttgatagggatggcattgaatctataaattaccttgggcagaatggccattttcatgatattgattcttcctacccatgaacatggaatgtttttccatttgtttgtgtcctcttttatttcattgagcagtggtttgtagttctccttgaaaaggtcctccacatcccttgtaagttggattcctaggtattttattctctttgaagcaattgtgaatgggaattcactctttatttggctctctgtttgtctgttattggtgtataagaatgcttgtgatttttgcacattgattttgtatcctgaaactttgctaaagttgcttatcagcttcaggagattttgggccaagatgatggggttttctaaatatacaatcatgtcatctgcaaacagggacaatttgacttcctcttttccaaattgagtaccctttatttctttcttctgtctgattgccctggccagaacttccaacactgtgttgaataggagtggtgagagaggacatccctgtcttgtgccagttttcaaagggaatgcttccagtttttgcccattcagtatgatattggctgtggttttgtcatacataactcttattattttgagatatgtcccatcgatacctaatgtattgagagtctttagcgtgaaggactgttgaattttgtcgaaggtctttgctgcatttattgagataatcacgtggcttttgtctttggttctgtttatatgctggattacgtttattgatttgtgtatgttgaaccagccttgcctaccagggatgaagcccacttgatcatggtggataagcttttcgatgtgctgctggattcaatttgccagcattttattgaggatttttgcatcaatgttcatcaggagtattggtctaaaattctctttttttgttgtgtctctgccagactttgttatcaggatgatgctggcctcataaaatgagttagggaggattccctctttttctattgattggaatagtttcagaaggaatggtaccagctcctctttgtacctctggtagaattcggctgtgaatccatctgctcctggatttttttggttggtagactattaattattgcctcaatttcagagcctgttattggtctattcagagactcaacttctttctggtttagtcttgggagtgtgtatgtgttgagtaaaatggcattttacttctgagatcgtccccctccaaaaccccataaccacactataatagttaaaaagaacatcagaataatcccaatggaagaatatcttacaaattccttaccagcatgcttcaacactgctaaggtctttaaaaataagcaaagtctgagaaacagtcacagccaaaagaagcccaagggaaaaaggggactacatgtaatgacgtgccttggaagcaatcctagaactgaaaacagacagtaaggaaaactaggaaaacacagatgaagtttaaactttagatagtactaatgtatcagcaatggttcattaactgtaatcaatgtgacataatcatataagatgctaacagtagagaataatggaagtggagaactgtcagaagaaaaaattacaacaattgtagcaaaatgattggattggctttgattgtgatttatgaatcatggcagcatctcctttaaacatttagacaaggtgttctgatgagctgagccctggaggtgggatttatatgcagaaaggactgaagaaagaataaaagccaaaacatcgattattcattacaaagttactttccttttagggttaaagcagaggggacttatttaatgccagctaaaattggcctctttggctctttggctattattccctctcccaatgttttagaaaagtcaaataatcatcttgctttcagtttggtgatgtgaagctttagcaagagtaacttcattttgatatggtctagtagaacctgaggaactcaatccaaataagttatctcctatatattttatctaactgtatgtagaaattctttgtgcttatatatgaattacttttctgaacaaacaactgatattatcacctaatgttttgatgaaaaagaatagaagattagaattgaaaaaaggaagatgtgctaaaaatggtagaaagtatagatatagcacctgctcaaatgtgccatgttatgaaataattaaaattttaagatgtatgcattaaaattaaatacagcatatgaaacaaatatgaggttatatttagatggttcagtatcctcatgtctatttctctggttgctttttagtagcaagaaattgattccagacatctcttgtttttatataatcaatacatatcaaaattttccttcttttgtagtaaaagaataactttacatcacagttagagacaagaagatatttacaggttcttcaaataaaatgtttaagagcaattttgaaaaataattaagttagtaataaaaatttcattaatattaatgaggctcacaatccacaagatttatctaggggaaatatttaatagattatatgatgcatttggttactactgatgatggctaatctctttctttcaaagtcaatagtaataatctatcagttcagtgacagcatggtgatacctcctactctgttttgccacacttacctgataaagcattaattaatcttgtataattaaaaagaaatgccaaagaaagatataatagtttactcttccaaaggctgagatgagtaattttgaggagtacaaagtcttctattttggaattaatcattcatcttactttgacgtctcatttacttatccattatattttggctctgcattgctttgttttatagtgtctgggtgtcaactttccgtgacatatcttagtttggttaggtgtatcacgtaatgaaaacaaaacactccagaataattttacaaaaacatctatatgtatttaaatctacattcatcatttaggtattatagtgaccatagatgaatctattttagatattttatacattgatttttcttaatattattcactctgacaaatagcttgcttccttacatcatattgtgaataaaattttaagttccagagagaattattcatgcatgtagctttttaattaaaaagagagagattagtcaatcttttttcatgaggtaaccatatgaaaggcaacttttaattgctctttttgaagtttctttctcaattgcaaactcaggtttcacaatgcatgttgggaatgagcgagaagaggttgatctgatgatacatggagtctgaatgcctgctggcggggtggaaaggtgcctggaaatgcacactcaatcacactgaatgatggcaggatatttatacttcctaaaagctggggattaagacttttttcatctgttcattttcctctcttcagtataccctggagctcttgttccttacaagtggttgtaaacacagttttcccacaagttctgcttcacgatttcctccactatattagtgttctctcttacatgccatgctgtgcctaatggcttaccatttctgtgtcttttcagacgacatcctttgtggtgccacagcacatggatttcagaaccgcctgtgaggaggtgagtacagagctttctgcttttcaaacagggaaaacagaatataagcgggaaacacttggctccaatttatatagggaaattctgcttttggcagaaaatggagagaggaggatgggctctttttccttccagattacgttctccttctgcaaagatagaaaacctaactgtgcatggaaagccttggactttaactctttctttaggaagactggagcatattgaatataattgagttgctcctcttcaccaactctgcacatttcaggtagtggaagtgttggaaagaattcttttcacataaatggtaataaattagaagacatctaaggttcctttcagccctaaaattctatgattttatgattctgatagtatttaagtaattcaatattatttaagtattaatacacaagaatttagattctctgtagagctgtcatcacatttcagcacgagttaaagtggcacattagtatttcaaggatgataaacagtgttcaagtttacagttcaatagtgcatggatgtgggcccccagggaatacaaccattccatcttaggaagaaaaactaacttttttttttttttttactaaatatgtaacattcaaagtattgtgttttcattcttcaggcaaaatacaaatacttgcagcttaaaaatgttttatatttgtttaaaaggtttaaagcatttttttattgtatataaacaactcaacaaaaaccaaccataactgcttacctctggtagtgttaaaatcaaactagggaaagacttcagttcttaaccttgtgaagactgttactttagtgaaatgtcatgtgtttacagttcttgcatgaatttgtggaaagtaactccttattttcttctaaagcaattgaaaaaatatatatttaaaaatacttgtcactgttggtaagaagttcagaatataaatataaggtttttcagaaaactaataaattgcttttatatttctattcttatgtttctacttttaatgctttaagcataacattttaaacatatctctatgctaatactcatcaaattacaaggcagtttttttgtttacaaacctttctcatgtgctacactgaatactataaggtcagagtgtgtacattattcatctttttaacttagcacttattggttcatatatttttaaaaactgaattaatgttctagaagctttgtattttaaattttaattgtctaatttctgtttttttttttttttttaatggagtctcactctgtcgcccaggctggagtgcagtggcgcgatctcggctcactgcaagctctgcctcctgggttcatgccattctccagcctcagcctccgaagtagctgggactacaggtgcctgccaccacgccaggctaatttttttattttgtatttttgtattagagacgaggtttcaccgtgttagccaggaagatctcgatctcctgacctcgtgatccacccgactcggcctcccaaagtgctgggattacaggcgtgagccactgtgcccggcccatttctggttttaattgcatacttaattttaaaagtagcaagtcttctatttccattaatgtgcaaccttatgtcttgagtagtaaggcattcattgaaacccagtggatatttgtgtgaatgagatacttatgggacacatgacattcatatggtacagattggacagtggtcaaatactatttaacaaatggtttattttggatttcagaggctggaaagatttacaagagctttttgtaaacaaaattgttttgatgtactaatttgggatatttctcaaattctattaagatacagaagatttatttaattggtaatactgttattaccatactagctcttgtaaattagtaatccttagtactgaaaagagtgacaacctgttactgagataacaatatagaagaggaaattaaatcactcatgtgagatatagctaaatattgctgaagtcactatatgtgatgccaaaagacaatagtgatcaattttggggtaaatatttacttaatggaatccaagtgttcaggaaagtgaggactcatctttgaatagaatgatttcagaaggcttcaaagagaagggagtctggtgccaggactcgaataatggctagaatttagttaaggaaaaggccatgatcaaaagtaatccaggaatgggaacgtaaatgataagatgcagtttgaagcactttgcataaaagaacatttagtacactactgctacaatgcagtacagtataagacaaaacaaattaaatcgtatttggcacttgaaacatggaaatactgtggatacttgcaagaaaatttgcagtccattttattatctctgcctactttttgtagtttgtcatttcttatatctgatattgtgagtatatttcaaaattaatagaccttaaattttaaagtttcatgaaaatacattttgtacattttgaaagactagaatataaattaaaaaggccttaacttttaagtagaaaatggatgatattctacttttataaagatccaacctaggtcctatgtttaagaaactacaaattcttaataagtttaaatgtgagagaagttaaatgtgagatttgtttaaagagtaaacccatgcaaattcataaacattttcttgatttgcagaaagcatagctaattaataatttaaatatgttgccttttaggcaattaggaagtattgcttttcaataattcctttaagcaaatagtctccaatgtggattttgtaaaaagttccatctagaatcgtccatcagtcagagaagaagaatattttacttatatcatttttaaatgaatcatccctttaaaattatgtttggtgtatattttataaagtacaaaatacattcatacagtatctatatcacatgcattcctttatttatgtgcaatggtatgcaaagtcaacgaagtttggagacaaatgatgttacattaataaaaagaaagaagaagattcatgtctttagtttatattaaaatttgagaccaataattatgtaggtgattttcgatatctaaacaatttgggtccacagatctgtaaagactttgcaggtggggctgttttaggtttgcagcaccaacctgcagctgctcccatgattcggtctctcatttttagctcttaaagcacttcaggaaggagtggagatcaaacttcttcctctatcagacagtctcctagtagcgtggctttggggaagatcatcctgtaagttccagagtagtctcttactcgttttttctctctagtggtcattgcttcaatacaagaagaatagctgcttcaagattatgttgttcttttcaaaattatccacaccccattaggagattattgataaccataatgctctccagtgaaagatgccaatagccatgtcattgtatacaggacaactgggggtggcattcttaaataatctgtgtatgcgggatagcagagtgtgtggtgaagagcctagctgcctgtgttgaattctagccttttcttcctctaggtccctctgcacttgtctaatctgtaaaggcagatggttgcgttaatttttgttaagggagaaaaataaattaatacttcttgtcacacagtgagcactatataaataattattattaaacaacaaataaatgaaatatatgaccacatttcatgagtgaggatctcagtccagcaatgctgattctaatcaagacagtgccctgaaatggagtttatccttcttcttgcatctctcagaggagctctgaatctaatgcacctgtttattagttcccaacttccctgctcagtgcctgtttctgtcaacaataagtgtattttaactttcccatttattctccatcttctactctgctacaagaaatacatttagaacacataacagtgaacatattatctccttgctcacatttatgtatggcgtctcccttaccgtccaccatctgcccatcatacagggcgttagcacgcctggtcctctccagacatctctcctgcagcggcccctgctggaccacacaggctcagcggcgagcgcaccttcattttcttgcatcatcacgtggcatgcattttcacacttccatatctttactcatgtgttccctcttgattaaaatgacatttgttcctctaatgattgtttcctcaattaatttttttcaagacaaaccacacatatttcctatcctccataaactcccttccctcatgaatattaaattcccttccccatgttgctcccatatcagatgtcatattgtgttttattacatatgtactttcgaagtaaatacgaggccgagcgcggtggctcacgcctgtaatcccagcactttgggaggccgaggcgggtggatcacctgaggtcaggcgttcgagaccagcctggccaccatggtggtgaaaccccgtctctactaaaaatacaaaaaattagctgggtgtcatggcaggcacctgtaatcccagctacttgggaggtgaggcaggagaatcgctcgaacccaggaggcagagattgtagtgagccaagatcgctccactgcactccagcctggggcaacaagagcgaaactctgtctcaagaaaaaaataaaataacataaggtaaaatagttacgaatactatgaggccagggaatgttatctaattaatgtctgattctctgttaatgctgcacagtatttgcaaaattaataaatgtgtgggattttaaatgtatttccatgtgcaccagctgaattttcatggtagaacatgtgtaatatctgtaacctctggaaatgtattttaactgatctgttttagcacttcgtgtactgttttctccagcagctatttattggaatgtgtgtttgtgagtgtgtgtgtgtgtgtgtgcttctgtgatttattctaaaaaaaatccttctcattctttattttctgcaactcttgtcctttcagaacccaaaagcgagctcaaagactgtattctgttttccagacaactatctaataatttgtgaacattttacatagtatttaagtgaatgatagctttggccatatagaaattaaatgagaacaccctgatagctttgttttagctcctcaaactttccctggatgatctttagtatctctttgatgtgcaccaaaagtatatctctgggctttcagggaaaacccttctaacatcctgaagttcaaacagagcattatttgtgattatcagctattccattacacttctgggtgaaaaaatgtcctggaatatactgtactgaaaaatcaggaaatgtgctcatttatgatcacttggctttgatgtatcatttcatatttccactcctcagagtggcttcccccctcaaaaaggatgcatgtcggcccctctccaatatcctattgtaagcatgagtgactttgtgtaaaaacatagaaaaaatatgttctatattagggaaagtacaatctgcttgtgctgaaagatttttgtcctctagatatattcacttaaagtattctctagattagtcagcctggtttcatgagcacttgtgtgctaatgccatggatgaagaaaacttgctttccttcctcatgaaaaagcttctgtttttcctaaaaaagacatcataccttttacaaaataattctagaataatataagagtgtatatgatagagggcaaaagagtgtgcatcagcacacgagaacaaaagcagtttagagaaagagttatctttggaggctgcagtatataaatatattcccatcaatattacagcggattcttttaaagtagcagactcccagcaatagccatggaaatgtatattccaagagaaagtctggtattatttgcctgggatagcatgctccttaaatctaaggatagatttcacatgtaagtgatataatatgatatttgtctttctatgcctggcaatttttactttgcaaagtatcctccatccttatctatgttgttgcaagttaaataattttattccttttttatggctgaatagtgttccactgtgtataagtaccatattttccttatccattcatgtgttgatgggcatttaggttgatttcatatcttggctgttgtgaatagtgctacaataaacatgggagtgcagatgtccctttgacatactcatttcatttcctttggatatatacctagtaatggaattgctggatcagtttttaattttttaaggaatcttcatactgttttctttaagggatatactaatttacatttccactaacagtgtgtaagggttcacttttctccacatcttcaccagcatttgttattttttgtctttttgttagtcaccattctaacttgggtgaggtggtattacattgtggttttgaattgcattttccttatagtaagtgatgttggagttgagagtagaatagtggttaccacacactggggtgcatggaagggtcagaatcgggagatgttggagaacaggtacaatgttacagtcagatgggaggaataagctctgttactctagtgcacgctaggatgatcacagctaacagtaatgcattatatgtcacaaatagctggaagagagggttttgaatgttctcacaacacatatattattagtgtttaaagtgatgtatatgctaattatcatgatttgataattacacaatatatacatacatcaaaacctcacattgtttgccatgaatacttactatgtgctaaatttttaatttgaaattaattaattaattaactctgaggataaatgtatatccccatatatatattccactatcttaagaatgactcaataattattacaagaaaatgtcatttccaaagtggtcattattcctatggactttttggtgccgaataagagctaaagattatattctatctcaaaggaattaccttttgtgtctgtgacaagtgggaatgttaagtgcactttctagggagaatatttatattaatccaggttaatatatgtattctggataaatgacaagactcatggacttctttggtgattactaagataatagcacaagttcagaaatctttacagtctgttttcacaattacccaaagtatataaagcaaacacattggattaggcatcaaaaatcttgggtcttaaactaggctccaattttaattaactgtgttaatctgggtagtttatttcaccttgttacccttatttccttctaggtataaactgtgtgtgtgtgtgtgtatgtgagtgcgtgttcatgcaagtctgtgcatgtgtgtatgcatgcatgcatgtgtttgttggtgactaggaatgctgacatagtggagtttagagtaggctggggcagtgggaggggaaatggagaaataggagtgtgttccttctttttgaagtaatggaaatgttctaaaattgattacagtgatggttgcacaccattgagtatattaaaaatacatgaattgtacattttaaagggttgaattgtatggaatttgaattatatctcaataaagcaattattttttatttttagattataagtattacaaaaatcctcattattttaaaaatgtagtacatgtaccataatccttactccccacttctttgtgtgaattttgtgacattgttttcattatccgagtgttcactctacttgagatcattctcctttttttcccttgcacccacgttaagtattcaatttcaggctcatcagagtgtgttttcaccacctcttaaatgttattcaccatgttttgctgtaaactggccacaaaattacaacctataaactaagtataatttttcctctgtttgtttttttttttaatctgaagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgtaagtagctttttcttctgttgaaattttttgtgtttgttttttgttaataaaaatgtttattcacagggcattttaaatatgtttttctttcagtgtctagtcaatggttctgcatggaatttttgcttacatcattaagtaatcagcggccctgtacgagaaccttgcctggggtccatgaacacatatttcgggcccatctccagcctgttgtctatgactcctagctgtcatcatatgatgggagtgacactgtattttctgattattctaccattttacatagagaattaattgagaactgtgcatggtgatggcttttgctctggtcttatctttcatgacctgggactactgagagtggtgccagggtggggcccaaccttcagcatcactgaatcaggagacgttaggcagcggtcactgaactcagcgtgagtggtgttcccctaggatagtgtctaaatgattctgtgggcctccctaatagaattatgcccaagtgctgtagcaaattcttttctccaatgctccaacccattgacacattacactgctcctaatctaacttcagaaagagccataaattacagtgcaaaactgattgctgtacctactcatgtcgaggcagcatagctatggaagacatccttagatgagattagattttattctgctaaaagacattatcataagacgagttctggagtttatcattcattgtataataatgctattaaaggcttctttttagcaatgttgccgtatgtgatctcagaagaaaattacagacagtagcatgtagtctgctccctgctttccccaaacatctgcaactatttagcatggagatttaatttgtaccttattaacagacttaccttggagtgtttagttggtggtgaataatgctgaacttgagctctcacatcacttcttactaacaccctatgggagtcacacaaggccctaaatcaataggcctttgccaactaaagataatggacattttgcagactgttaactattcttttgtcacagaccatttaaatcattctgaatcatgggcctggatgtcaaggctgattaaactgttcccatggggttgtcctttcttccctttggttaataatagagaagtgacatgagtcatataaccctctagaataaatatatcacactggtcccagatcaaaaaataaaatcagtaaaatttactactttgatactgaaataatattattgattttaaacttcacagtcaataatagctgatacacatagacctattctcttcttaaaagataattgtgcatataaataaagctcagagtgctaggaataatgaagagaattaaggagaaatatcctatggcattttcaacaaattcaaaaaagcatttgacaaaattcaacacccatttttacaaaacactttagcaagatatgaatagacaagaattttcttaatctgacaactgtcatctaattaaagcctctccctaatatgttagttaacattgaacattttctctgagattgaaagcaagtcaaggataataccttgcttaataatcaatgttgttcaccatgctcctacagcaagtcacaaacgatatataaagaacaaaaattatacaggaagaggcaaaatggctttacttgtagatttcatgatgatatgcatagaaaaccttaagaattctacaaaagatagaataacactaaaattaagcaaggttgctgagaataaggacaatagcccaagttaattgtgtttctaaaactacctacaagcaactagaaatgaaatgaaaatgcaatccacaataagtcagaaagacaatacactcaggaacatatttaacaaaagatgtatatgatctctaccctgaaaactacaaaaactatgttgaaggaaattaaaagatataaacaaataaatggagaaatacaacatgatcataaattaaaagctaagtattgataaactgtcacatctttctaaatattccaaaccagtcaaaaccccaaaatatttgtgtggatatgtacaagttgattccaaaatttacatggaaatataaaggacttacaataaccagaataatcttgaataaaaagaacaaagttggagtgtttattctacctgatttcagcgcttactataagattctaataataaatacaatgtaatgctgtaataaattcaggcatagcaatcagtggaacattctaaagagtccaaaaatagacccactcttatatggtcagttaagtttttttttttaactgtggtaaaatatacataatataaaatgtaccatcttaactatttttaagtataaagttcagtagcatttcgtgcattcattttgttgtgtaactatcaccactattcattgccagaattttcatcatgccatactgaaactctgtacgcattaaacagtaactctccatgctctcctcctcttaacccctggtaaccactgttctactttctgcctctacatttgactattctgggtagatcttgtaggtggaatcatacaatatctgaccatttgtggatgacttatttcaattatcataatgactttaaggatcatccatgttgaagcatatatcagaatttcattcccttcaaaggctgaataatattccattgtgtatttataccaccttttgtttatcttctcactcggtagtaaacattgaggttgtttccaccttggctttttgaaaaatgcctctaggaacatgggtgtacaaatatgtttgagtcaccactttcaattatttggtgtatatacccagaagtgaaattgctggataaaatagtaatactttgttcaactttttaagaaactgccgtactcttttccacagtagttgtaccattttccatttcaacaagcaaaatacaagggttccaagttctccacattcatgccaagcctgttgttttctgtgtttttgataatagctatccaaataagtgtgaggttgaatctcaccgtggttttcatttgcattctcctgtcaattaataatgtagagcatcattttatgtgcttattgtctacttgtgcgtcctctttgggtaagtgtctattcatatcctttgtctatttttgaattggattgtttgttttttggagcttagttgcaggaattcttaatgtattttagatactagtcccttatcagatatgtgatttgcaatattttctcccaaattgtggattgcctttttactctattagtatttttgatgcacaaaagtttttaattttaataaaatccatgtcaattttttcttctattggtcgtaccttttataccatctccaataaataattgccaaattcagtgtcatgaatcttttccactatattttcttctaagagtttacaatttttgctcttacttgtgcgtttggttatattttaagttaacttctgtacatagcattaggtaaagatccaacttcattctttagcatttggatatccagttcaaaatcatgtgccgtatatataagggggtatttgtggcctctctattctagtttattagtctatatatttgtctttatgccagtaacgcacagttatgccttttgtttgtttgtttttactgtagctttatagcaaattttgaaatcagctaatttgggttccttaagatctcaaataaattttggaatgaatttttctatttcttgaaaaaatatcattgcagtttttataaggatcatgttgaatctgtagatcacttttagtagtatggacatcttaataatagtaagttttctgatagatgaacataacatctttccatttatttatgggtactttgagttcttttagcaatgttttgttgttttcatgtacaagtctttcaaccccttgcttaagttaaaaccttagtacttgataatttttgatagtattgttaaaaattattttcttagtttacttttggattatttattgttagtgcacggaaatgtaatggatttttacattttgattttgtattctgctactttgctgaatttattagttctaatagtttattgcggaatgtttatggttttctacatataagattatgtcatctgtgattcaagataagtttacttattcctttcaaatttggatgactattatttctttctcctgccttattactctcgttaagatttccaatactatgctgaataaaagtggtaaaagcaggcattttttttcttattccagatcttaaaggaaaagcttcatttttgagtatgatatttgctgtgggtttttcatatactgcctttgttatgatgaggtagttgtctactattcctaggtggctgagtattgaggcagttttgaatgttatcatcgaaaggtattgaagtttgtcaaatgctttttctgaatcaattgagatgatcatgtgtgctttttaattttttttcttctgctctataactcgcttttcttacctgaaagtacttcctgggacccctgtcccgggaaggaattctatcttctaggtctgcatctgaggaaagccaatctacaacagagaaagtagcacactgtactttcagataaccagatattctttgagaaaaactccctttgtctgttttttaaaacctcccactggtaaaggcccgcagacgcctctgtattaaaagataccctctttaaacttgacctttcacagtgcactgtttgtgttgtattgccacaatacatagtccatgtgctcgctggacagggatcacctctcttatcagctaattatgagatgaatttgagacagtagggcagagataaacatccaactttggagagcagaaagtctcatctgagtattacaacaaatagagtgttaactctcagtctgcttaagtgagtggaaaggttaggagaatgttctaaggaaaggcagatgttagtctgaagaaccataggcaaggatgctattttgttatctagaagcaatgctctgaagtcctgggtggaaaatagaacagtcaggggcaggggactgaaaacaagattgctatcaggcagtttactcatgagggagaaaaatgaagctccactctgctgaaaaatcctgaggattatagaatgttgtagttttttctccaaccccacaatagggaggaagttgtttatattttcaggtctatcacattagctgaaagctgcttctaggattgtctttgcctgacacttttgacctgccttgctcaggctgaaagaaagtgttacagttcagtcaagctcctcttgcccacttcacagaaaaagccaatacaatgagacagccagtattgcattagatgaagagtttaatacttgcaaggcagtgaagcaaagaggacaggagatatttctcaaatctctctgcctggaaatttgaagactagcgttttaaggatagtttggtgggcaggcagctatggagtgggttgtactgactggttggatcagggcctaaatcacagtgctgccaaaactgtcctcaggcatttagttagctcctgggtggagtcactggtctgggtggcattagctggtctactagaatgcaaagtctgaaaaatatctcaaagaccaggctgaggtttcacaatagcagtgttacctagaggggcaactggggaagttacaaatcttcagaccactggctatgtgaatcctgagcagcaagcaattataaaaagcaagctaggaaacaatgcctaggtgctgtttatgcctatgtcttagcagaaatcaggtccctagcataattataatcttatggcctttcattagttttacaaaggcagtttcagtccccagtatggaaaagcttaactttgggaagcgactattatcatccttgctttaaagttccttgctttaaagttaaactataaactacatttttccattaaattgtaaagtaaatccctcccatagttattttggcttttgcacagaaataagcaaaggtagttagcttgtgaggttagacgcactagggagtcagttatgccagatttctctcattgttataattgtgcaaaagtggttccaaaagcccttgtggactgggactcagggatggcagtgggacaaggtctgggatagggagttagtggtaggcctgacaatttctctgtatctgcaccaaggcaggagagggtgccatcagccccaacattaacccactgaccatgaaggataaacagtgagatgtgagcccaggtaaaaggctcactctgagggagagggcacagaactgagcatttggagaagctccagtcaggcaaaatgttggtatctgaaaatcaaggattggcagatgggtcaaaacccaggcgtcatgccaagtaaccctcttagctccttgctctgaattcctggacatattgtagggcatagctcagttgcagaaacaagaattgagaattcgtggtaagtatgtaagggcagcctctgtgagagggcaggatataggatttggatagcaaagggacccctgggaaaaggctttgcttcacaaaatctctagaattaagagaggaaacaggtaatacagggtcagcgccagaaaaccacaggctgatgaacctgtagctgagctccagggctttatcagggtgagcttctaaagaaggtgacttaacaataacccctatcaaatggggcttaaacctgctcatcactccctgattagtgggtctgggagtttatagtagaagtcaagtagctcctcagaggcttcaggaggtgacgcagagaaaaaacactcttgacatatttagcacatctgactctaattttagttatgcagaaagtcctataaaatattgatcatttagaaacttgtgtcaacattttcacctacaagagacagctagagagttaaaactgaaatatccaacgcatttactgtgacttctatcagcaaaatactgctttcccccagtgccttttattaactacttttgaggaacattctgtgatttcttcagagattacacagttgaagttttagcattgagttcatatcagataaaacctgtttcatctgtgatcatttaaaaatagtatcaaaacgtaggcagcaattattcaggatctttagatgcagatagtaaagtgactgttgatcagaatgatgcatggccgttgtcagatagatgtgttaaagcttcagttaacatacaagaaagcaatcatcttcccctggtgctccaggggagctgaaatccaacattcagttcctgtcatccttctgaatggtttaccactctaagtcagagatatctgtggctgttctcatggtagtatacccttcaatgggccctgaaggaaaattaaatttagcctgtgctagttttaaatattgacgaaatatttttaaaaggtaaatgagggtaaaatcaatacaagatggctatctatttccccatagagacaccagtttcaaaggtgttgctagtaaaaagatacgaaaaccatgaagaatcatggagcttaaattccaaacatgacagaactgtcagataaatagcatcaatacaatcagtacctcagtgtaatgggcaccattagactttaaaatcaacagaacaacttcttccagtttccttgtggaataaaacacacaattagcaatcccacgagtgaaaccacaatttcctgaagatgactttaagagaactaatatctactattaaccttggaatttgtactggctttcacatgggtgtgacatgatgtaggatgtggctttttgaggttcattatctgtgaaaatgtgatccagagagagaatgtatctagactagtgcacctattatggatagattcttaataggtcatctgggaggcatggtgtgtgcaggcctagataggaacattgttttttctttttcccacatcacagagctactcactgaaatctgtcaacatggagattggagtctgtgtacacacacatgcacaaaatacacgttgtctatattttttaaacttttaaaaaaaactcttgtatgccaatgttatcatttatttgctgattttaatgagattgcattcttcttttatttaaaaatattgaatttacaaagaatatatatattcaaggtgtataatatgatgacttgatagatatatatacatacacattgtgtaatgatttttacagtaatgtaacacatctatcacctcccctgctatatattagaccctgagatcttgttcattttataactgaaagtttgtacctttttatcagcaccttctattcttccattcctcagcccctggaagccaccattctactttctgtttctgtggattggacttttttttagattatgcatgtgcgaggtcatacaacatttgtctttctgtgcctgacttatttcactaagcataatgtcctctgttcatttatgttatcacaaacggaagggttcccttctttcctctggctgcattatagtcaactgtgtatatatatgctttatccattcatctgttgatagacacttaggttgtattctataaaatttgacccattctaagtaaatacaactgatttttcaaaatgttttagaggtaaaagtggtcactgattactaacattgataaagaagctatcagtttaatcccgtttttacatttgattgtatgtttataaacttttcaatcagaagtattttatgtttgcgcttctccttgtttggcctttttgggtagactgacattccaaatgtgtgcaaataagactaagaaaaggaaggccgggtgcggtggctcacatctgtaatcccagcactttgggaggccgagatggccaaatcacgaggtcaggagatcgaggctatcctggctaacacggtgaaaccccttctctactaaaaatacaaaaaattagccaggcatggtggcgggcgcctgtagtgcccgctactcaggaggctgaggcaggagaatggcatgaacctgggaggcagagcttgcagtgagccgagatctctccactgcactccagcctgggtgacagagcaagactccatctcaaaaaaaaaaaataaaaagactccatctcaaaaaaaaaataaaataaaaacagaaggaggaagggaaacatttttcaggagtagaaaaatacttgcagatgggcaagtactgtttagagagttgtgattttataacagaaagataatacaaaggcctactcttgaaacctagagtgtccctgtcttttattattagagattgttaaattgaaaagacagtgctggaaaccccttctctctatttcttatgtgatgtttcttttttgccagtcagtagtcaccactagggacatttacgttcctaatttcccagggcttatgcggttccagatatggcagccctggaagaaaagattatggctccagtgaaaacattgtcaccggatcccctggtggtggccgcagtgggattagcccgagttggtcacagttgtagtcagcctgtggcaacaccatctcaggttccatagtctgggcagcagtccccagggactactgcctgtgtctcctttgattaggatagacagaacagatgcagttggaggtgttggtgttgttatttgaaggctcctccaaacgtagaagcaaatgaatgataatatttaccacaagaacaatggcacccacagaaggataccttattaacagagttaatttttttgtgaaatacattgctaggtataagattcatattaaggatatttatcttaacgtgttttgttaaacctagcattgttaaatccacttgttattgtgcatcttgttttattttacctttaaaataattttaatatgagattttctttatacatataaagcaaatttattgacaactctttaatacttagttttttcttacattttgtacctatttgtctttctgtggggcactaaaggtgactccttctttcttcttttcagttcataactctttctttgacagattgagtccattatttaaactattgaatttctgattcttattattatgtttttcacttctaaatgaatataatactatctgtcttatcgggtaattgtgaagatgaaacaagtgaatgcaagtaaaagagaatatggtctctggcacatagtaggagctcaacaaataatatctttattaacatgacacatgatacaatgtgggtgtgtatagacatggtgatacacagagtacagaggtctaggtcaggaactgctttccagaggatgtgattaaggtcccacctcttaaatagcaggtagaattttgcgggatatatgtaattttgcaagacatatgtaagtagcatttaaagcagacaaaaagtgtatgcaaaattaccaattaccaaactgttaaaaagcatgccataatcaaggatggtttagtcatgggacatgtttcctgcaggatacagttgggaaggatgtaaggtggggtgcaaagtgtattggtgggttgtggtgccatcaataaagggagcaatttaagtaggaaaatcaggttttagagcggtgtacaatggaagttgaattgagaccaaaaaagcttagaccatttagaaccaatgcaattttgtcatagactgatatcaagatggaaactaaaatcagttaattaaagcaatggtgcctggttccactggcttatcagttacattgctcacgtttgtgattttacagatttgtcatacttacaaaaagatatgtcattatttacacaaatgaatttttataacattaaatgtgagtgtaaagttcaagagggttatgatcaatcatgtgcccatcagcagcttaatgatagatagagatggatgatagatgcatagaggcatagatggatgacagatatagacagatgattgattcataggtatcaatagattaatttaacactgttcatttgtttttttcttcttccttaaaatggttgacagtttgatgtattttgtaatattttcatcccttagctctcatactgagttttggagtttgagaaagtctgccatctatctattttttctttgtaggaaaactgtctcttctttctgagtgttgaagatttcagaatccatgcccatccacgccccatggtaatctgctgtgtcactctgacatatctatctgaagatgtattttctttgcttgagagtcacaagaccggaatatgaaaatttatgtatttcttcaattctgaagaatttttagccattatctttgaagagcctcctctctattatctgtgttctttccttcagtaacatttggatggatgttagatcagctccctggattctccattttcttacgttttttcatattttgaacttgtctgccctctgtggactctaaaggcaactcctcccatcttcctttcagttcactatctctctctttggttacattgagtctatcatttaaactatttattgaatttctgattctggctattatgattttcacttctggaagttctattctatcctattttatatttgcctcatagtattttacatcacgattatacatttgatatctcctttctatcaatattaatcttgttagacaatcctatttatatgccgtatctgtaattgcaagatctgcagtctgtatagatctgactctgttatctgttctttgttctgctgctgatgcactcactaaattccatttcctcctgggatttctcactgtgggctcatggtcttggcactctataagtatccctcagtttggctctataatgtgttatgaagatagaatttacaattagttctttcaggtgaaggggctattagcaacccagatattctttaaactaaattctcagttggggatatgaggccacacaggtagagacaattcatcacacacccacctgtgggccaattcacaaaatctcagaaatggtttttaattccttcatccagatctgaggtcaagattggcaagtttctttactataatcctttgggtgataggaatggtttttcatactgacacactaagagagttttctatgcaggtgacggtgcctctcctgtcctgcttgggtccttccagtgatggccctgaatgtttgcctttgggtctctgctcgtacagacttcttacctgtgaatctttatacttcgtcatcattcctgacaaccgagacatttttcttctttccttattactctgactgcacgtttgacattatttttatttattttattcatcattttattgtgtgttgtcttggaaagggattttaagtatatctgactcaaaggagtgttagactcaagattagttgtgtgtgtgtgcatgtgtgtgcgtgtgtgggtgtgtttgtggaaaagctatcagatctgaagtgtacaggcctggcttctaatatcagtctccccatttgccaactttgtgaacctgtgtgacttcttgctttctctgaatcgttgttcgtatgagggaaaaacagagaccacctactatacatagttcactgtggcaaaattaaatgagattgcattgcctaggtgaccactagaggtgaacaataaagatggctgtcttcttcctttcatctggataattgtttctttctctaattcactttgtctaaaactttaaattattatcctggatgagtaatttgagctgcataaataatctttctgtgtaaaattagaaaacaaaacttctcaccttaaaagaaatttttcgtgagtgaacaaatgttgtttaaatgcaaaggagtttcattattattgctttaaaccaaggagttctgaaaatggcagtaatgtaaagcagcctagaggtattccaaagactacagtcttatgaagtttatattgtttctgcagaaaagcatttacattaagaaggtaatatttaaatgagattgaatataaactaataggctgaaatctatattgttctggaaatcagtaatcaggacacactagaaagtgaaatggaataggtaataacgtaaatataaggttaatgtaattgatgtaaatgtttacttatacctatacatgttaacataatatatcaaggagtaagatttttggttaaaatttctcatttttgtcaacaatatatttgaaatatactcttcccatgaaacagttcctcagttgttttagtagcacaagtagttttagtttaaaaaaatatatttttctcctctccaagccagtaaaagttcctctttcagtatattatataaaacttaaattatttttgtatttaatccacataattttgcatgatgcttgctatcatacatattgttaatttttactacatatgtggaaacggtaagatagccacctttttaaaaaaattaataataaatttataagtggaatgtgggtaaccaaagcccagagtttaaataagccttttaattttcagagcattaagaaggtagtgattgaaatttatatttgataaatggattgctgttaatgtatctaggcattgaagagacttaatacatgataacgatgggtgattatgatgagagagtaaaatggagaatgttctgagtgttcaaatattgagccacataggccatccacttttctttgtagcttaatatttttatttttacaatgtcaatgcttttatcttcatgttaattattttagattgtatcttttctctcttcatctgtgacagcagtctgtgcaatcttaaacaaaatgtcccaagtacaattaaacttgtataatcatcagtatggatattggtttttgcactgggcattcactcagtgataatctgtggtttgtgggatcatttgctcgcacactaaatattcctggattgccatggaggttataagcatagtcacacatgtgcacatgcatggaatggttctatagttcctcctgcttcattccattctaaaacactaagtctgttactttcctatacagtgggcttggatccacatagccaatatgtcaaatgtgtagtacaaaaagtgagaatctgagtgagaatttaaggccttcttacttaagagcataaattttgaaatatgtattaaacaatagtggtgatttatttttcttctttatggttttcaagactattattaatatatgagtttgcagattagctaaatattggaaatttgaggtgttactgtggcttgtattttattatacttagttcttggtaatttacagaatattttagatagattacttaaaatgtttgaagtgtatttgagacattttgtttatgactacttatattcatatcacatcattattttgctaatttgtctgtatcattgcctttttccataaatgaagactttgacatccatgtgatttaatgctaagatctgtccataatagagtgatagccgtgctgaactctatgtcatggatcccattaccctgcattagagcaatggagtcaagcagatagatacttgttctgttctatccatagcttaacacctgagtgactgtgacgatgattcactgtctttgcttcaaatgtcacataaagtaatacattcaagtgcactttggacactataaattgctatagtataggaggacttatttttacttgtacttgaaaaagtgttttaaagaagaaattctaggtggttttaaacccactggaaaatttggtaaaacaattgtaacttataaaaaatttatcttcaaagatatgtataacttcagtttgaaccgccatgatatacacttttctaagtgacatcaataaaatcaaagcaattgcttatatacacaagttggaacatctctgcgataaggagcatatgcagaattttgacactccttgaattttctactagttatgaagcacgtgccacattatcttactctgtagactgtatattctgagacttagcgatttataggagagaactgacttctatttcagagtctatcaaaaggcacctatgtgatcctcacactttactttctctagacgcaatatttgctttcttagcatgtagaattatacttatgaaatgtcgcccagttataatattccatggcttgcttctcttttttcttctaaatctcctctaacagtggagatgttatataattgcctgcaagtggctcacgtaagatataaataagagtgtgcttttctcacctttcatgaactactacatcacacttcattttcttgtccattcagtcccttgctcccttagatgacaatgtcgtatcaacttctctctccaagtgtatccaataacatctctcccattctcactccaaggtgatgcccttgcttcctccttcactgagaaaatgaagccgagaaaacaatgccccactgccatttatatctaccttcctggacttgtgaccttatgtgttttctccctttccattaccacagatgatctgtctttcctcctatctaaggtcaccatctagtcatacactaaattccacccttgcatgcatcttcaaagacatcgttccagcaatttcccactgcatttgatgattcccactgtatttgattgcatcatcaaatgctcattttccactagatcattctgaccagtgatcattctgatcattccaaccaagcaactataatttccccttcttcaaaagcaaaataaaaccaaactctctcttggcccgaaattctcctccagcatccactgcatttctctgcttcctcttccagagcaaagccattgaagtgattgtttctttgccatcatcccccaaattcagtaattcatccccactactccactgacatttctctcttcaacttcactagttatttcaacattgctcaatttaatggatatttctcattcctaattttacttgtgttttcaacaccactgacactcctttctcctacaaatattttcttacgggcttcttgggtaccctgcattcctcttttcctccaatctctaagcaacttagagatctctaagtctcagtcttcactgctgagtcttttcttcatttccatctataggcactttaatggtgcaaagcttagttctttacgttattctttttcttttactttttgcacttgctctttcagatgtcatccattctcatggctttaaaagtgactaagctccagcttatatcttaccctgtcctgttccctgcactccagattgagatagtgcaacaatttgtacaatatctgcagttggaggtccagtaggcattttcaacttaaacatgaagttttagttaaacttcatgtttaactaaaacataagcttaaacatgttaggcaaactaaactcttgattattccccaaattaattcccttcacaacgtttcctatcccaatagagtaaatggatatgtcatctttccagctgcattaggcagaatccctggaatctctcattactctactctttcattgaagccacatccaatcagtttaaaaaatcatgttagctttctgtcaaaaatatatccaggatatatccagtctttcttctggaaagtagggatagaactgtttttctctattatttgtactaggtaaaaattaaaaactatgactattatcttttaaaaaaaataccataaggctctgaaaggaacagggagaaagacaggttggcttgggattttaggatttgaggaagtcatagaaccatgttctctgatggatttttggcctcaaatatcccagattggttacaggagaagccagtaacctggaaatgacaataagcccaaccaaaacctttctttctagaaaaaaaaatgggcagcttaacaagaaaataaattcttccaaaataaatgctctactctaccaaaataccacacacacacacaaaagtgccctctttctatctccaatggcaatggccaagtggaaaacttagacttataccctcaccaggctgcactgatgttctccagctctgtctgccaaggtggtattagggaaatcataaatgggaacaaggactttcatctttatggagcaaggccaacaacaatcccccacaaactccacctcactgtggtatcagagaagattatctggttgtctgaaattcaaatctgtgcagcccagtgataaagaagccatcgcaaacaatggagtcggttgagacctctcagagagcagtaataaggctctcctcctcccctcaacaagggttgtatcagtggaggcttagtagggagctaaaattcccacctatcaccagcagaaacaagaaaattctcaccttgaatgagaagcaataattaacagatatcaaatctgaaatgatacagatattagaattatataatatgaatgttaaaatagcagtcataaaattgctatatattagttacaaacaccattgaaacaaatgagaaaatagaatatctcagccaaaaaaaattcaaaattattgaactaaacaatacaataattgaaataaaaactcaatggttgggcacaacagcacaatggacgggacagagaaaataaacagttaacttgagacagagagaacaataaaaattactcattctgaaaaaaaaacagggaaattggactgaaaaaaataagaagtgtctcagggacccatgaaaatgtgacagaagttctaacatgtatttgagcagagtcccctgagaagaaaaagagttcagactcagagtatttaaaaaacataaaggctgaaatttttcaaaattgtgcaaaaagtatgaatttatgtattctggaaatggagcaaacctcaaaaagcataaagtcaaacaaattcatgtcaatcacttcacaagcaaattctgaggactaaagacaaagaagaatacttcaaaagcaacaaaaaaggaataacagcaataggaagaaaacaatccaaatgacagtgtagttttcaccagaaacaatgaaggccagaaggaagtgaaacaatagttttaattgctgaaaggaaaaaaattgtcaatccaaaattctatatctgtgaaacacatcctccaggaatcaagagaaaatcaagacatcataagatataagaaatataagaaaagtatttcattaaaggaatggctacaaagatctctctcaacagagaggaaatggttaaagaaggaatcctgaaacatcacaaaggaagaaaactaataaaaataattaaaatatatgtaaatataatacattttccttttccccttaagttttttaaagtaagggtgatggttcaagccaaaattttaacattgcctaatgtgcttctcaatgtatatagagaaaatatttgtaacaactaaaaataggggaagataggccaggtgcagtagttcatgcctgtaatcccagcactttgggaggctgaggcgggtggatcatgaggccaagagatcaagaccatcttggccaacatggtgaaacctcatctctactaaaaatacaaaaattagctttgtgtggtggcacgtgcctgtggtcccagctacttgggaggctgaggcaggagaattgtttgaaccaaggaggtggaggttatggtgacccaagactataccactgcactccagcctggcaacagagtgagactccacttaaaaaaaaaaaaaaggcggtgggcgggggaggggggggcgaagataaagggacatttaaatgaaagtaaggtttctattacttcccttgaactggtaaaatgctaacactgttaccagaaaagggtaccaatccataccccaagagagggctcttagatctccacaagaaagaattcagtgtgaatccacagagtaaaatgaaagcaagtttattaagatagtaaaggaataaaagaatggttacttcataggcagagaagcgttcggggctgctagtggcccatatttatggttatttcttgattgtatgctaaacaagaggcaaattattcatgcttccccttttaaacaatacagcataacttcctcacattgccatgacatttgtaaactttcatggtgctggtgggagtgtagcagtgaggaacaccagaggccactcgtcaccattttgtttttggtgagatttagctggctttttttattgcaacctattccatcagcaagacctttatgacctgtatcttgtgccaacctcttatctcatcctgtgactaagaatgccttaacctcctagtagtgcagcccaataggtttcagctttattttacccaaccctttttcaagattgagttgctctgtttcaaactcctctgacaacaccaatagtcagtgtgaggaccataggctcttggccccctaaaggtctgctgaaagatcactgacatgagacatattcattaataggaaaaaaggcatacagacttacttaattaatgtgtatacctgggagccttcagaatgaagactcaacttttcagtaagtaataaaagcttatacaccatcttgaaattacagacataatgcagatccagagtatctccaaaaacaggttttaatggcaagagaggttatgggagggagaaaggaggaagattgactctcaaagtggccttgttgtgcagaccaagcctctatagagtaaatgtttcttttcagacttttaaaaatgtcacacactcaatctctcctagacctggaaacggcatggaaaggagaggcctgattgcattaatggagattctctacagatgcaaattttcttcacaaaagacaggctaataagaccacttctgtttgctggccagaaggcagccatttcaaatatgtcaacatatatattttggggtaaaatatttgaatttccttcaacagcgatctatctatctatctatctatctatctactatctatctatctatgtagataggtagatcacataaaattgattgaccaagtagacaaaaagatatatagaaggactcagaaacattatcaaccaaccagatctaatgagcaaatgtatagaacgtacagcagattacacattattttaaaataccaaagaacatttactgtaactgtatgaggggtactttctgcctgctgcacaagtaaagaccacagtattgcagtaaataaagaaagagtttaattgacatgagtccagccactccatgcaggagacagaattattgctcaaatcaatctctccaaaagctcataggttaggagtttttcaaaggtaggttggggggaaggggtgaggttgatcaggtaatgtgtgagagattaaatcctgggtggaaccacaggagtggggttggtggggccagatggagccaggtgttagacatgcagaaacctgaaaagatatctcaaaagaccaatcttaggtttgacaatagtgatgttatttgcaggaatggctagcagttgtgtatgtctacactttactagaatgcaggctcctctactcttccctagtcaggtgatctctcattagctttaaaaggtggctgagttttggcaaagggctattaccatttaaactataacctaaatagcttccaaaattagctctggcctaagcccagatgtaattcaggcatgttgaaagttaaaggcaggaggtgggtttgggggggttagctcagatctttttagctgtcaaacttttctcactgatacagtttttgcaaagctggctttattatgatgatataacatatttttgaccaaaaatgagtaaatatcaatattttaaaagaatggaaatccatacagtgtgtgttctctgactatagtggaatcaaagtagaaaccaataacagggagatacaaggaaaatcttcaaacacttcactagagtgtgagcacctaacagaaatttttaaatcagtttgttctctgttatgtttatagcatgtaaaacagtgcttagtatatagtagccacacaacaattatttgaaatattcaatattgcaaaaaacaatcataaaaatcctctcatttctcctggttctgaattctgcatttaagtttcattgactttttataatttaattatccctttccaaaagttcatttattcacttatgtttttgcactcaacatgactataaaacctttaatttttaactcaagttaacttctttatcttttctcctatgttcttgccaaaggatgaccaaaactattcattcaaaggccatagcagaatgctatctgacagagagatattgtggatatattcacaaaggcagtattttcaagccaactatgaagaagggtagctttcaaataaatcagtaaattaaagctcagtacatgaaatgactctcagcttgagaaaatctacaaagaaaatggaaaagaagcataaagcaaatgagagatgtaaaaaatataataaaacctatggaaattggccaaaaaatgtgatgagatgagacttaactgactagtagttagagaaaggtaaagtctgagtgcctgacatcgcgttagggagccgacataaagtggtcaagtccttaacttcaaatgatgaaaggctcaagtattggagacccaaagttcttctaaagtcttggatatggggatgatctaaagatggagagactgatggaacctgtgtttaaggttttagacaagaacatctcttgtcatagaccaaagacccttcttccccagtatctagccctaacaacaaataaacatgatgtttgcttttggaatgggtgaatcaaaggttccgggaatgtgctccaggtgaaactgtgatgaggcattgcactgcaaatgaagggattaaacatggagagatagcgatatgtgccaggtaccctccctcagcatcactcctctcccagaatacagaacctaggtctgtaagtccttggcaagtaaatggaagattcttttcagacaaaacaaacaaacaaacaaaaacaaaaaaaggtaatctcaagagaaagcctcaacaacagatgttgacatttggaagctcctcagcatctgtaaggtgtaccaatcaaaaatctagccacatatatacagtttccactatcatttttataccatgcatggatgagtgacgaaagtcactagtaaacacactgaagaagtcaattttaaaaaggaagacatggagttaggaaacagatcctacatagaaatatgatacaagtttccaggaatgggatgaatagaggactcagggcaacagctgtgtagcacacaacaaacttaattagctgacatgggaacaggaggatgtatgagtccaggagagagatagatttttaaaaaattaaaaatcacactatcttatgattgaaaacattaaaatatgtgactttgttaagaggagttttactgttctttaaatttgggaatcaatttcatgacagacaagtatatagaaaactaggaaaatttcaaaagccatttaggagcttcaggaaatgctaagaattgcacaagatggaaacataattatgctctgctcattgtattcagtgggaataatatttcaaagtaattacataaacattgactactgactcactagaaaattataattatatttacaggtgaaactggaatataaaaagtgtatgtgtgtagcattgtttatgagaaatcaatagtttttttccatagtagagatagcattttttaaaatggaagacaataaatcacaagtatattatttagaaatatggaatgagtcataagaagaaatggcacaagatttgcgtccgggcaggtgaaagctaagtggagataagggcaaaaagggattttttttgtggttaatacaattcatgtagaatattagacttttaacacaggggtcccaactggtaccagtcagcaggaggtgactgctgctggtcacacagcaggaggtgagcggcaggtgatcatgctttacggtctgagctctgcctcccatcagatcatcagcagcatcacattctcatagaagcacataccctattatgaattgcacacgccagggatctaggttgtgcactccttatgagaatctaatacctgatgatctgtcactgtctctcatcacccccagatgggaccacctagttgcaggaaaacaagctgagggctctcactgattctacattatggtgagttgtataattatctcattatatattacagtataataataataatagaaataaagtgcaccataaatgtaatgagcttgaatcattcctagtccaatccccaccacttggtctgtggaaaaatcgttttccatgaaaccagtccctcatgccaaaaaggttagggactgctattttaacatacataccttactttgatacagataaaaattaagcattaaactgaattatatgaaagaaaggtcaatctgatattattggtaaaaaatattggagggtgacgtttgaatcaaggaaaacacttaggagatgcaatgaggtgctgaaataagcttgcagtgaagaagcaaactggacgaattcctaaatcccagttgttttatattcttctgtaaatcaagtgcaaagtagagtgtctggcattctggaagtcttcattaaatttaatttcctccattaaaaatgtgctttattatttaggacagttttagattgacagaaaaaattgcaaaaataatatagagatataccacacaccgaggctcccctattaacatcttacatagtatggtaagttggttacagtgaatgaatacattttgataggtaaattgtaacacaagtccatagtgtatttagattttcttagttttcatcgatagtccaggatcgcatccaggacacctctgtatgtagtcctcagatctcctcaggcacctcttgtctgtgacactgtataagaattcatttgttattgctttcagcaataatgatatttggtcaatgaagggccacatatattacagcgtatcataagattataatagagctgaaaaatttctagttacatcttaatgatcctgaccctgtgtaggcctaggctaatatgtgtgtatatgtcttagtttttaacaaaaacattttaaaaataaaataataataataaataaaaaggcttatagagtaagaatataaagaaaatattttcacacagctatacaatgtgtttgtgttttaagctaagtgttattaaaagtcaaaaaaataaaaagttttataaactttttactttataagtaaaaaatgttacaataggctaaagttaatttattactgaagaaagaaaagtattttaaaataaatttagtataacctaagcatcgagtgtttacaaattctacagtattataaagtagtgtgctatcattcacaatcactcaccacttactcactgcctcacctagagcaacttccattcttgtaaaatgaaaaatatttgggaaaaaaatacaacaataagaagtaacacaaatttaaaaagcaataacgtataataactatttactatataggctataatacagcaatatggtataacagctttttaataactatttatatagaacttacattgtattaggtattttaagtaaagatgagttaaagtatacctggagatgtatgtagatcacatgtaaatactatgccatcttatatgagggacttgagcatctgaagattttggtattccaaggagatcatggagtcaatcccccacagatactgaggaatggttatgtatacttctacctatatagatataaaatttcttactcacagtaaaggtttcatgaaaagcaaaaatcaatgttatttcttagttttgtggtaattcacccctaaattaccattatgataaaagttacagtcaaaaatattatttaacaacaatctaaaattacaagccaattttactaagtaagctttgcagaaatgtaaacataatgattattattaatatcaatatttacaaatggtatgaatctgtttaaaaactgtattgaagacactgttaaagaaaacagacactaatgcaaatattcaaatatgtatatatacactttttttatttttaattttttgagtcggggtctccctctgttaccaagcttgggtgcagtggcatgatcatagctcaccacagcctcaaactatttggttcaagctgtcctgcctcagcctcccaagtagcttggcctacaggtgcataccaccatgcttagctaagcttttttatcttttgtagagacagggtctcacaatgttgcttagcctgttctcaaaggctcaacctcatgcaaccctcccactctggcctcccaaagcactgggattaaaggcatgagtcactgcacccagcctcaaatacatttttactaataatttaaaaatattctcagaacaaatttactcaattgttctttctatattatgccaagaggcactgttgggactatatgttcaaatacaattcattagatgatttgaattagtgaatctttgtctcacacagccttttaaatatatatttgtctaactcaattagaagtcccatgccagagttttcagttagagaaacagtagattagacaaaaggaaataatgatgtttaatacagggctcctcagagacattaccatctaaataagtgttaagaaataggagacaggaagaggtgcagtggcttgcacctgtaaacccagtgctttgggaggcaaaggtgagatcacttgaggccaggagttggagaccagcctagacaacataaactacatttctacaaaaaattaaaaaattagttgagcatggtggcatatgcctgtagtcctagatactggagaggctgatgcagaaggatctctttagcccaagaattcaaggttacaatgagttataatgaagccactgcattccagcctcggcaacagagtaagactgtgtctcttaaaagaaaagaaaaacaataaaagaatagaacaggggatgaatatatgggcagtggctcctagttcctgcatttcaatccagagaattcaccactaactgaccttggtaaagttacttaacatcactgtggttctgtttatattacagatgcatatttgcagaaacaaaagtggaattgtgcaattttcaattctttgcaaagctaacaaggaatatttaaattttaaatagtctgcattatctaatgaccttaagtcacatatgaaggacctgctacaaactacaattttcagtgggctttagggaatgttaatctcctttttcaccactacacctgtagcaagagagaaaaacccaaaaccctgagagcttgcctggggaatgaatcaaagggaatgaagcaagaaacctcagaagtgctgtaaatgtgatctgtaaaagaatttataggaaagggcctttttttgtaatttattctctttaattagatttttgtaaaattatctagggaggtaagttctgtgcctaagtcttctaagatggaatgctattacttccttgggaccaaggaccccattgttcatttaaagtagcatcaaaaatacttaggaataaatttaacaaaattataaaatacctattctgaaaactaaaaatcatgagtaaaagaaattaaacagagcctaaataaatgaaaagacataccattttcatgtattagaaaactcaatattattgtttatattatcataataatcccaaaattgatctacattataaatccctataaaaaaatcccagctaatttccttgcaggaatagacaagctgatcctaaaattcataaggagatgaaagagatttcaaatagctaaaacaatcttgaaaaaaacaaaagagtttgagggttcatatttcctgatttcaaagcttactatgaatagacagtaatctaaggtggtactggcataacgatagacataatagatcagtggaatagaattgagagttcagaaataaacaaattcatagtcgacttatttttagtaagagtacccaaaccaatgaagaaagaactgtcttttcaacaaatggttctgggacaactgaatatttacacatataataatgaattttgaaccctacctcacaccacatacaaaagttaattcaaactgcatgaaaaatctaaatttaagaactaaaactattaaaactcagaaggaaacatacatgtaaataattttgacattggttcaggcaatggttttgtaaatttgccatcaaggtgcaaattacacaaaacacagaaaaaacagataaatggcacatcataaaaatttaaaacttttgtgcttcaaataacactatcaatacagtgaaaagacaatacacaaaatgggagaacatttttgtaaatcacaaatctagtgtggtatttatatccagaaagtgtaaaaagttctcgcaactcaattaaacgggcaatcaaaaaatgggcaaataatttgactagatgtttcactaaagaaggtatataaatggtaagcaaatgaacaaagtgccatcagggaaatttacatcaaaaccattatatacaactttatatcaattagggtggctataatcacaaagatagataataaggtttattgagaatatggagaaattgaaattctcatacattgttgatgagaatataaagtgacatggccacattgaaaaacagtctgacaattcccattttcaatacttggtatatatgcaagagaaatttttacaaatgtgccataaaatgcttgcacatgaatgttacagcagctttattcacagtagccaaataaattaattgtggtgaatgcacaactgtgactatgctaaaagtcattgaattgcacgctttaaatgggttaatttcatggcatatgaattatatctcaaaaaatatattcttagaaagataaaaactgtgtatattcacatatctataaatatttttatgcataaacatcagtatcaatattaagctaaacatgagtttatactgatgtccccaactagtttccacaacctcgtgaaatttttagcctcctcatcttgcttatctgttagttcttctctaacacagagaaacctggattcccttcatccaccacccgtttacttgttaaatttcaatatacatgtataatagtattaggattgttaacctgtatgtactgtgaaagggccatttatgcaaagtagcccccacatgctgaagaagccaaggaaccaaagaatgagacagacaaatcgactttgttctaaggggtgttttattggcagaacttgcagacagaaatgtggtcttggttggctgcaaggcaagtagatctctgcactgttactcctcagatccagggcttgtataccataaggaagggtgtatatgctccagcaagacatttaaatgcaaccatccagaaaaggcaagaatgacatgttcttacaacagagatggtaaatcaggatggtaaagcagaaatcaaaatacattcatgggactgggatagttaggaatcgacatggaattccgagatggaatcactcttgtcttcacaccataccctgatgtgaaacaactttatcaaccagaatacagttccatgtgcagttcctttagcctttcatctttagcctttgtcttacagatgcttgtgccttacttcatttccacagtgacttaggtcacatcatccccctgccccatcgctgaggttgtaacatacattcgtaatgtagttcaagtgtcacagactgcattccttctttagtcctgaataatttttagacatttgcatacattaaggttactcttggtgctctaaagttctatgggctttgacaatgtataatggtatgcaatttctattgtaatatcatatagaatagtttccttaacatggagattctgtgtcaatgtgggtttgtcagttgtaacaaatgttcccctctgataggagatattgataacatgggaggctatgcatgcagaatctccatgtctttttgcagcttgattgctcatttttaaaattattcaatacttcactgtatagatgtaccacagtttgtttattcattcacttattgaaggacatcttatttggctatttatacttattggtgataatggatacaggtagtataaatatctgcatgcagatttttgtataaacataaactttcaaattatttgggtaaagacctaggagtatcattcccagatcatatgttaagactagggttagctttgtaagaaactgcaaaaatctcttttgcattcacaccaataagaaatgaaaattaaccatgaacagtattcttgaaagcatttggtattgtcagtgttttggattttagccgttttaataagtgtataatattatctcattgttattttaatttgcaattccccctgacaaatgatgttgaacatgtcttcataggcttgcttgctatttgcatatcttttttgattaagtgtttgctcaaatacttcagccactttttaattgggttgtttgtgttcttactgagtgttatgagttatttgtatattttggatacaagtcttctatcagatatgtgatttacaaatattttcctctagtccatagcttgtctttttattctcttagcagtatctttcacaaagcaaagttattaattttaatgtattctcatttatcaacatttttataaatcatacttttggtgttgtatctaaaaactcatcactaaaccaaaaatcacatgggttttctcctgtattctcttctagtactactgtgtttttaatatttaagcctatctatgatacactgtgttaatttttgtgaagagcatagtatacatgccttttcttcttatggatgtccaattcctccagcactgtttgttggaaaaaaatatctttgcttttctctattgaattgtttttattcttttgtcaaatattagttgattctacttttttgtttccttttttttttggccacctgttctgtaccagtggtctaaatgctttttctgtcaaaaatgccatgttgtgttgtgtactaaaactttatagtaagtcctaggtcaagcatcctgagtcctccaactttattcttcttcagtattgtactggttattataggtcttttggctgtccatctaaacctaaaaattagtttgctagtatccacaaatagcttgctgggatttttattggaattgcatagattttaaaaatcaagttggaaaggaatgacatcttaaaaatattgagtctttcaattcatgaatacggttatctcttcatatgttttgaacatatttgttttttctctagattttttagtttcatatataaatcctattagtattatgttagatttataccaaaatatttttcttttattttttatttacattttattttttattttatttatttattcatttttttgagactctgtctcactctattgcccaggctggagtgcagtggcacagtctcggctactgcaacctccacctccctggttcaaacgattctcctgtctcagcttcccaagtagctgggattacagcgcacatctccatgctcggctaattttttctatttagtagagatgggggtttcaccatgtcggccaggctggtctcgaactcctgacctccagtgatccacctgcctcggcctcccaaagtgctgggattacaggcatgagccactgcgccaggccacaaaatatttcccttttagtatgtgttattttaaatggcattatgcttttaattttcaattccaatttctcattgctgatatgtaagaaagcaatttaatttttataataattccatattctatgaacttgctataattacttaccacttctagaagaattttttttcaattctttgggattttatacgttgacaaaaaacaaagatagtcctctatttttgttcatttcataagcctttatttcatagtatttcatcactgcgctagctagaacatcaagatattgaatggcaatggtgaacagggatatcctggccttattcccaatcttgcagggaaaatattacatttctccccctttttactacattgcaccatgagttttctgttttttttttttttcattctaattcttcattttatctcaggcctgttgggatagaaagaacagcagagatcagagaaaacttggtttcaatcacaacttggatcttggtcaagttaatttcactcttttacattttgattttctcatctgttaattagaaaaacaatttcctacaccagtgggttgctgtgataattacttagaataatgtttgaatgaatatttattcatttaacattttaatacctaactttgtttcatgacctgtgctaagtgcttgtgagataactttgtgtaagacataggtccagctctcagaaaacttggaggaaaaaagtcgagggcatagttctcttcaataaacaattctaagtgctatgagagctataagtacacatagtagatttttatttattttttattattatacgttaagttctagggtacatgtgcacaacgtgcaggtttgttacatatgtatacatgtgccatgctggtgtgctgcactgattaactcatcatttacattaggtatatctcctaatgctatccctcccccctccccctaccccatgacagtccccagtgtgtgatgttccccttcctgtgtccaagtgttctcattgttcaattcccacctatgagtgagaacatgcggtgtttggttctttgtccttgccatagtttgctcagaatgatggtttccagctttatccatttccctacaaaggacatgaactcatccttttttatggctgcatagtattccatggtatatgtgtgccacattttcttaatccagtctatcattgatggacatttgggttagttccaagtctttgctattgtgaatagtgccacaataaatatacgtgtgcatgtgtctttatagcagcatgatttataatcctttgggtagatactcagtaataggatggctgagtcaaatggtatttctagttctagatccttgaggaatcgccacactgtcttccacaatgtttgaacagtttacagtcccaccaacagtgtaaaagtggtcctatttctccacatcctctccagcacctgttgtttcctgacttttgaatgatcgccattctaactggtgtgagatggtatatcattgtggttttgattttcatctctctgatggccagtgatgatgagcatttattcatgtgtctgttggctgcataaatgtcatcttttgagaaatgtctgttcatatgtacacatagtagatttttaataattagaggccatcatcctcattattccttttccaacttcagctactcttcctcagttgtcaaaaagaactattaacattctctattttctttccattattgttctacaaacaataatgtattggtttctgtaacacaaaattaatacaaacaattttccaatgataatctctttagtttctgcatgatttccacttcttcctaacttttttccatacaaatctcaaaatttcaatacctgagatatgtgatgccaacttttttttggtgtcatgtatatttttcttccaatatagttcatacaatctttctctatatgcaacttataatataatattccaaaaagcagggatgatagttatatttttctacaaagcatactaagtatttaatacaaggctttttttgtaacattgatgttgattatttaagtgtgcagcaagtctttatacagtccgatattaatcttgggctcaatcctttgcatttttgtaacgaaaaagaagattaaataaaggcattatatatatatgaaactgtataggagcatcagcctggattttgtgttttacaaaataaaatcactgacaatactttggtctcccaaaggacggtgctttgttacctggcaacagtctttacgacactcatgatgtgttaactaaatatactttcagatcagcttccagatattgtctgatttatgagctgagtatttgaaatggttcatttcttctttttattacgtctattttgggaggaggaaagaagcagaggtgtaaggggataaagtggcagagctaccgcaaacacaaacaactgggaatatattagcagaggccacaccaagaacagttatttcccttttcatgcttcctgctgcctgcagtgaccaatgtgcaatcttggttttaaaacactaagtaacttgttttgccttgtctctcctaactttcttaaaagtaagctaatgaagaagcagcatctggagacactggctataatttgcatgttgtgtgtgtgcccaggtgtttaataaaacattaagataagtgctgtttttgagattcttttggtggtttctgctgactctttagtctctccaaaatcttttctgcatcagcagttttgtatttgatttggaacatgttctaaatattctccaccagagattagagagtgggcttgtagagcatgagtaaagaagttcaaagaaacggtttttgaggaccctgcgatgcttgttgtttctgtcaaaggaaagcagcacttcagtatgcatttagctattgagcagcaattactgaccgagttttcctcatggccaattattgctaggcaaaacgctctacaaaatttaggggatggcatttgctgcttaaaatgcatttgctctgactgaaatttgtattttaagacaactgatatgggttgtctggatgactgcaccactgattttgatactgttttaaggaatcacatatttactttttacagaaaaggaaaaaagaaatagttcctgtcatacaagaattttagtttagttgggttgtcagttttataaaagcagtttacctatctattttgtaggaaaaatagtcacgatttaattcacctattcctgaatcttagtcttccagtatttgagttattctatgatgtaaatatattaaaatgactattacataagaatccctatataggatatcagattgtgtgtgtgtgcgtgcatgtgtgtgtgtaaatactaaatttctactctatgccagggtcttttacaaatgttaattctcaagacaaagcttttaattgctatgtattatttataagcattttccaaatttgaaaacagaggcttataagtaatttgctgaatggatgaagttgtatgaagctgtagctattagcatcattggcacattgtctaacttcaattccagtattgtttgcaatattcaacttctctttaatgaaccatttaatgagaaataacaaatattaattaattattcgacagattgcatttctccttttcaataaaaagacatttctaatacatagtttattttaaattattaatagattttgtgtacttataatgcacatgtttaaccttcctttttgcttttgtatatgcagccctgtttatatgtgtaggttttgcgatataaattctaaaatatatcttcccgtatttgtggttgcattcctggggtaatgcaacaaacagtatgctgaaaaataaaaacagactttgtggtagtatttaatacaaatagttcatcttatatttcaagttgctttgcataaattgttatacacatagaaacttatttgtacaattataattttaatgttggtttgaaagtatgattggatgacagattataagagtaacataagtatttttgaaatagatgaaattactcagcacattgtcaaaataaagaaaatttattttatcgaatgctactcatttgcattcaatagtaataataataatttctaagtaaatatgcaccatcttcatcaaaaagtcttattttcaaaattcaaaataaatcaataatagtatacctcaaattctggtatggcaatcttgttctttaagtattattttgttctatttatagaaaccaaacttttggctaaacaaggaagtttttaaccttgccaaaatgaagagtcttatgctatcttaaaatatttagcaagagccaccagaagcacacatttttccaattttcactagttcttttaaaataatattatctgttccacacagtttccgcagaacaagagaatgagggaagcaattcatctgtaagaaagagggcagtatttacatttggaaatggataatgtgggcaaaaggtatttgtagagatatagggaccagataacaaatatctaccccagatgcaggggaaaagggtcagtgtctcaaatgattctgcataggggaatgttcaaaaagattgatgtaatggagcaagctataagttaaagcgttcagccctatagcatgcctccgcagtaagcactatgtaaagatgactgcccaaaatcagagcagtatcgatttttcaaattgaaaattacaggatttgtctaaatgtagctctttgttctcatgccatcatctttgtgattttgaagttttataggccagtgattgaattacttctattgtggagagaaaaagaaactgattgttaaagttgataattcaattatcattattacttagatgtgtaatttattcattttatgaacaagcaattagtttattttggacttggtttattcactttcaatctaaaacacacacatgtagcatttctgtgctggccacggcagcctcccagcttagctcccgaattccaggcagggatggagacagggccatggtttaccaggatcatatttaccattgcctctgagttacttttatataacctaaaacttatcatttcttagaaaataagaatacgtaatgtggaaataagaagaggtataaaagttaagattccaaaatatgtccaaaataatcattgagaagaacttatttttaagagtttaggagtttataacgcttcagtccctgttattttaacaagtaaccctttgatttaaaagtcaaagactatttattacaagatgtggaggcactatcccagcacagaagagttctcttttgttttaaagagcaaaagcaaaacccagaagaaaaccaaaaaaacaacaaaaaatggtgtgtaagtatagtattaggaaacactaaccattcttaaaaatcctgtctttcaggaaagaacggtgaccatcagaagacaaacagtaggaggatttggattaagcataaaggtagcctgcctttctagtctatccttacaaaggccatgccataagagctgaactttggtgcatttcaatgtttgctgattaataattagacaaggatggctatagcaaactccttaatatttggacggggatgtaaattaggtaggttctcacagaattcctgcaaactcttaccatttgatttagaaagtttagcaaagaatatgggaatttaccttatgattgaatttaactcattaactttctttgtctggtttttctgaaatgttaaatatgatgtcgtgtgcatatctttctttaaccaactggagtaggaaatgatgatctgcagtaaatagaacaataacaagtttcacactaataaagcccaatagtaagtgagatattgtattctgttcatcttgtttatttttcatttttaaaaaagaaatcagtaaatttaattgtatagtgctaatcatataggatagacttaaagtctttgcatatgctttattttaaaagtgaacatatgtgttcatttaaatttattatcaaattttaaaggcctttattttgtatattattgactattagagatgtaccatatctgcaatttattatcattgaaataaaggataaatttttaaagcataggaaattatgtaaatattgaagagttaatctcatgactgcaatgcctttgtcaaacctacatctcttcatagataaatgaagtttaactttataattattgggttagttatttgacttatatagggtgaaaataatttatatatttcaagtacacattgcttgaaatttcaacacaactcatgtcatatatttatggaaagcagaactctaaattttgtgaacatcagctctagttgactttgtgaaaatgactcagagtagaaatcagtatgcaatagcgttgtattgtcagtgataagaaaagaatattgctataaagagcactagcttcaaaacatattttgtacattcagtttatcaaagtgaaactttatcttatcaccaactaagaccagggaggcatgcagaacagattataggatgtgcaatgtattctatgagaatttaatcactcaataaatgagatttttttttgttttgcttttttttttttttttttggccaggctgtttattgagattgctgtaaagaatttaaaagtaccactaaagatactagaaaatccatgaataaaatccaatagtgagagctgatttcatctgaaatcatcatttttactgaaccaggcactaactctatttctggtagtagagcttccattaattttgtgtcacctagaaatgttcttttcctttttttgttgtttttcgtattttaaatttaaacccaataatgcaatgctatctatttttactaaaatgccacattttaacctagtttttaaagcatcaataatttttctaaataaagcttttcattttaatattttcattatttcaatccaatcaaaactattgtatatataataaatagaatattttttgaattaaataagtatgaattttccattcaattattgaccaaaaagtggtatttgagctatgatcaatatcttatattagagttaacaaaaaagaactttttgcaaaattcttatgacacactctgacaagaaatacaaacatcaagacttttatttagaatattactcattcatcctaaagaaattccttttatggttttttatttttactttctcatacttacctctgaacttcatttttctattttttaaactatcttttattgtgattatttagatcaaaatatgattctttcttttaactagcagtgttattacaaaaatctctttccctgtcatatatgagttgaataaactactgtgtttatttgttagcactattttccttagatctgagaatttaaaaaaatgtataaacttttttaaaaatatcattctaggctagaagcagaattagtattttaatgttgaactatttatttacagttttcaggagcaatttgagccactaataaaagtatgcatataaatacataaacgcatatcttaccactatttgcttcagttaagtaatcctcagcggcacacaccggaaagactcgtggtgagaattattaattaaaacctttatggtcttgacttaagatgacagaaggaagatggtatgttagacaactgaaaagccatttaccaatgtagttaagactcctacaggtgcttgtgaattccgctggactcagaacacatggtattttagttttatgttaaaaacacattctttaaaaaagaaaaaaacttggttaaagggtaatgaatgtcctttttagacagaattcagtcaaatgctctaacatgtgctgctagaagtcaaagccagctggccatgccctacactcttgacagatcttggcttggggactttcctgtcacagtcaccactgtgcagcatggtaattcctcacatctccccacaaactggacaaggacagtgtggtggggcttcttatgtaggtctgagtccattgttttgttgattaatatgtctcagcggctgtgggctgtgggcaacatgaagtctctgtagctaccagtgtccacaaatccttgatgtctgctgctcatgtgcaatattgctgtctctctcaagccctgtctccagccagggtaccttgtagggtacaagttggtgggaaaataaaagttagcctttaccttcatttttcttctttaccttatataagacattgtacaaacttctgggacaaaacgtgcaggtggcttggaggttgaggcagttcagtgtccctacggcttaattctaggactttaactcttcccttgatgtactaatgctagatatgatgcagaccacattgaggagggttcctatgtcaaaaattcctgaaatcccaaagaataagagaaaaatatatatttagtagaaatgaaaggaatattgaaacagctttacattttaaaaatatgacttaagtaagtccgaatcctttttcttttcaaattttgtctagttttctttccattattccttaatttttctctttaaattttttgaagcacattctttggagtttcttaccaaatctgagcctgtccttggaaagtcatacttaccatttcttcaaatcatctccaaaaatgctagacactcagtttgaaacaaagccacccaaaaagagttctgacatcaattacattgagatttagggtaggaattactgatttatcttcatggacttatttgtcctttagattcctaaactcctattgttttataacaggaatgttttaccattaaaaggtaaagaccaaaattgcctgtttctccatgttaattctaaataataagaaaaaaaaagcaaaagtaaagcccgaaatgacgtatgagcacaatgtccagctttagcgcatgctgcacatggaaaagcagatgccttgaccagggaggtgccacacacaggctgacactctcgcatccccatctcccagttttgatgaactatttgcactcagctcctaaagtgaaaagaaatcctttttaacctctggggagaatgtcccttcctggttgtgctactttctctgctttcttgtctcattctacagttattctttcattgctgtttagcaactgtagaaggatcaaatgagtaactgagccataatataatgagatgaaatttggagtcatgacacacatttgcaccggtccctccactgtctttaagtgaagcaaatccctactttagagcctggaaggagacagccatgcctccttcctctcttattagaacccttctagggctttatgcacctggctcactcctgctcccagccctccaggcatccttgcttatccaagatattctttctctcaggttgcctttcagaggcatcctcactcctgctgtaacttttgggattttttgacagtgatttagatttcttcctgcctgttattatttaattttcctttgttaaaacatctctcagaaatcacatacttgtgtgcctttttttctttgtattaatttgtctatcagtaaaaaaaaaaaaaaaaaaaaaaaaaaatcaagctcttcagtttacttttcacaaaaatttcaacaaaaagccctatctgggcttcccccaaagctggacaaaagaaccactaaactttcaactcataatcacatagtctgctgcctgttctcaggcagaaactgctcctttgaagcgggcagattcagcaggctagtggcatcctgcacatggcctcgggcctggctgcttttccctgcttgcagcaccatttctactggcatttcctggttcttctcccagccccaccaactcttgtctccttcccctctcaagtgcccatcctctgggctggaccatgcagagacttggcatttatataaataactttaatagtttcctcaactacatctgcagaaatcaccaaatttctgcatcgtaggatccaatattattgtattttgccttattcttcctatcgggattaccatagggatagtcatgttaaagcaagccatcgtcttgcccttgtgaggctttatttatctctcatatcttttaaaattcaatactatctagctgcacattattaaattatacttctgttcattgtcatttaaaaatttacctttgagggaaaggatgttttaaatgttattactataaatatattttatgcagtattttccaacagacacaattttcttatgaaaataataaattatctatgtccattaaataaatgtatgcaatcaaaggtgatttctatttggaagatttaacactacagcagtaaaaaatagaattataatcattattactcttaatcatcttctcatttctaaataattgctaatatttatgccccacttattaagtgccagtttctgagctaaatacttcatatttagttcaatttgcctttattatccagtggagtagataactattgttataccttccacagacaatgagattaagtgtcaagaggttaagtaattcatcaattgttataagcagtagagttggacctcagtccccctagaagccgatgacaaagtccttactcttaataactatgcttagaactataaaacctgaaataaattacctcaaaactctctactcagggacatagatcatgtttcctctctatgctgtttactttctggtttatttaaaactgaaataagaccaggcacggtggctcatgcctgtaatcccaggactttaggaggccaaggcaggcggatcatttgaggtcaggagcttgagaccagcttgaccaacatggtgaaactctgtctctactaaaaataaaaaaaaaaattatctgggcatggtggcacatgcctgtagtctcagctacttgggaggctgagacaggagaatcacttgaaccggggaggcagaggtcgcagtgagctgagatcacgcctctgcattccagcctgggtgacacagtgagtctctgtttcaaaaaaaattacaataaaataaaataaaacaaaactgaaataaatgtgtagctcaagtaagcaattttgtaagataaagggttgagtactagtcgtttcaaattttccaaataaaatatatatattagttgtaataaatgtatgccttttaacttattagtggtatctgggcaaaaatatttaaataacaaccattgctataagtgcatggacgtgcttgcatacatttttctgcattctgcttcccctgccatttttactcaagtctgattcacttgttttcactctagacaaaatgaatatgtccatttccatcataaaagtagataacagggacaggcacagggctcacacttgtaatcccaacattttgggaagccaaggcgggtggatcacaaggtcaagagattaagaccatcctggccaacatggtgaaactccaactctactaaaaatacaaaaattatccaggcgtggtggcacacacctgtagtcccagctattctggaggctgaggcaggaaaatcgcttgaacctgggaggcagaggttgcagtgagccaagattgtgccactgcactccagcctgggcgacagagcaagactccatctcagaaaaaaaaaaaaaaaagaaagagataacaagcatacagtaaagcttaaattgagggttatggattagtcccaaaaatgagttgaaaccactggtcaattatcatttcaaagaccattacattttttttcattacatagctttattgaggtataattccaataccatacaatttacccatttaaagtgtacaattaaattgtttttagtatatccgcagatctttgcaagtatcacggcagtcaattttagaacattctatcacttccagaagaaatctcatatttattcatcacccttttatcccctatctcccctctttcaaacctgagcaatgaccatttccctattttagactttcatatgaaggtaatcatatagcatgtgagaaagacaattattttttgccaaaatcaaacgaagtatgttggcaggtaacgatagcatccagaaggatgatggcacatgcccgtattcctccaggtgatattcctttacttgcctcttctgtagttgtccattgcagctcttaactctaattactgttattctgtttacaagtagtttcctttctctaaaaggaaaaatagtggttagctctatgcatcttccctgcacccccatgcccataatatgattgattgattaattgattggagtaataataatattgaactgaaaagattacttggcaagactcctgatgctctaaaagcattccaggttttatttggtggtatttcacagtaatgctagtaaaaccgttgtgtagagtcattctcaaaatgctttagatggaattatacatccttcttcctacagagctagctataaaatccactatgctttgtaaaaagattatcacaaagctgaacgatgtatgtgcgaacattacctgggctgtgctttagaacactgccttccttttcctaatcttgtatttctccataaactacaataacaatgctcagttaattcaagcattctctaaaccacagtcatgagccacagtcccgcccaggagtgccttggggagaagatggtgatgaaagccttgcctggacctcaggccatttatacttcagtaggaaagtagactttgatcaaattgttaccagaataaatgtaaatcacaggcatgatccagtgctacataagtgtattatttcaagtaaggagacactaaaggagggggctttaagccaaaatttcaaaaatgaacagtttccaggttaggagggaaggaggagcataactggccagacaacagtgcatgctgacatccttcaggttcagggcgatggaggtccaggagctacactggaagagaggcagtttaaaggttctcattattattcaactgtcatggaagcctatcacctgttttaaacaagccacatgatttgattattgactggaaaaccttacatttccccatttaggccctgcactaaatctaattaactgtagcagctgagctgctcacattttctccagtaatgaaggcagcgtgattttgagttccaattttatcttctgagttttgtcttaaaattcagtaattactgaagtcattttcagaaattagtttaaaaagtacatcagagctccaaatgtctaatttaaaagcaaaaaaaaaaaacaggccaggtgcagtggctcgtgcctgtaatcccagcattttgggaggtcaaggtgggcggatcacctgaggtcagggaggggttcaagaccagcctggccaacgtgttgaaatcccatctctacaaaaataccaaaattagctgggcatgatggtgagtggctgtaatcccagctacttaggaggctgagacaggagaatcacctgaactgggaagtggaggttgcaatgagtcaagatcatgccattgcactccagcctgtgaacagagcgagactccctctcaaaaaaataaaataaaaacagaaaaccaaaaaccatgtttggattcaaaccattcaaatttcaggataaattttacatataagagaaaaactgtggtaaaataagtgttacattttgcatttcaaagatggttacaatagtctccacttaaccttgggagatgcattccaagaccccagtagttgcccgaaactgcagacagtattgaatcttacactgcatataacatatttgcttacatatgcaaattcatgataaagtttaatttataaattagcatagtaaaatattaacaataactaataataaaatggaattataataatacactgtaataaaagttatgtgaatgtgcttcctttctctcacaaaatgttgtattgtactgtaccctggataactgaaaccacagaaagtgaaacacaaataagcaggggattgctgtacaagtctgggtgttgaggaaagaatgggattattgagtcaaccctcagaaaaactctatctcaaaagccttttctctggacaccaagaataggtttcccaatgtcttgccatggtaatttgcattaatagtctatgcatttaaaaaaaatgggttcagtagcagaataagagaaaagggtgaaatgcaaaaacagctgaaggaaaatactctgataacagcctcactgaggagaccagcaaaatcattgttgttccctgtcccaaaatatctgaatcacaatatctggatgattgtttcatggtttaattctacctaaaagttcatcagttaatgattcatttgagttaaccagctttttccttctaagaaacatagatgcatccttaacatcctttctaatttccaagtgtctctagaggctatcagtgaccttacgctgggcctggaaaagccgtagacttcattcattcattcattcattcaactcaacaaacatgtcaaagatagaccagacattattccaggcactgggtttacatcgatgcacaaaacaaactaccaaaaaatgtctgcaccctgaagaaatgtgcattttagttaggaatgggaagaagaaagaaaacaataagtgtgagaaatgaaaaaataacatgttagacactgataactgtaatgggacaaaatagaacagataaaaggggattgggaatttggagttctaactcataaatattaagggtcttagaagggattagtcctaatcttatttaccactttaatgctatgtgagtttcctcataaatcttaatacatgggctgtgttagcataatagccttcctttattcagtgtttactgtgtgctaaataagcacttgatttccaccacactgtcagccacaaatcactatctctgttcaggtcagaggcagggtcatcttagacacagtctgtgtttgttagggacacacagaccaaaaagcagaacaagtgggagccattgtaacctacgccagtaacttcccccacagagctgaggggtgcggtgcatgaatattaggttgctgtgaaatagtgaggaaaagggaactgagcagtgggtttgaaattcagtgagtaggacagttttcattaccttaattatcatatttcttcttaatattctggaattagaaaggactctacttgccaaaaaaaaaaattcaatattcctgcttttctaaaaaactattgactattttatatttaagtatactggcaattcagtgttaaaaatgggcatgcaagggaaaaaagaatatctcttccaaaataattttttatacttgaaacaaaagcttaggtggtttacatattctgaagatagaacaacctcaatggaattcagattgtcttttcaactaggctgtgttacaagttctatgcttctttttatatatgacattttattcttttatgtactgatttcatttctctactactgcttttaaccttctcaactctgtaatacagaaatgggattctttttccgtttttaaggatttattttattttctttcacataagtttagcttacttgtctttcttttttcatatctcatttagtcaactaataaatagtactactgcaggccgggtgcggtgactcacccctgtaatcccagcactttgggatgccgaggcagttggatcacgaggtcaggagatggaaactatcctggctaacatggtgaaaccccgtctctactaaaaatacaaaaattagctgggcatggcgcacctgtagtcccagctactcgggaggctgaggcaggaggatggcgtgaacccggcaggtggaggttgcagtgagccaagatcgcgccatggcactccagcctgggcaacagagcgagtctcctccgtctcaaaaaataaaataaataaatacataaataaataaataataaaaatagtactacttcaatattcttggcagtatgttttactctgcaaattgtttagtatgtgctttcacacaaggaggaattcaatactaaggaaggaaatgcagatgaatccctcatttttcatgcatatgtgcattctgattttgtttatccatttgttctggtaaaggtctctctacttccttggtatcccaacgggtcactgcaccaccaaaagcccttagctgccagcacagaataacttagcaggataacagtaatatataattatctggtgtttggaatcctaaataagaatttctattggatagcattgctacacattgaggagaatgcctatctaaatacataatcaatatttgttgataaatgaaaactttcaaagccaattgttattattggatgtctcagcaaaattctaaacaggtagataattttcatgggagcactatctacttagaggagaaattccacaagtttatttaaattctgcctaatatccacttaacattcccttcagagcctgtatggtttcttagctaaaagcagcattttttttagattaaaaagtacaatatatgattttctcttttcagggaggagcagaacataacattccagttgtcgtttcaaaaatctccaaggaacaaagaggtaatatgtttagagaattgtgtaccagccatttctttaaggcattgtttttgaagtgtgagatgatattcaagaatcctaaattacaatgtgattgactggctccagcttccccaccttcaggcattagtggctgagtctgcttcctgggtccttgccctttatcctcctgtgggagaggacttctctcacagaaggggaacaaggctgaaagataggaacccttgaaagcaggtatgagttagggactacacagcttttcagttgtttcattaaaccaacaaagatacaaaactaatgataacaagtcccatcaagtaaagacaatttcaagtgtctgtttttcagttctcatttgcaattttactcagctaaccattcataagaaactgtaggaaaaataatggagatataaagcagatgttgcaagaactgaaattagtaaaacaatgtaatgtttaaaaatgaacttggagccaattccatagctgacggattgaatgtctatgtcttaaacattttcacagagacctaataatcttaagtgcgtgagaaaatgtggtcttttacccttagaagagtggctcatttttagcaactgttaggtctgcaatagtaaaagtaaatggaaatatgtctgcatgtgcttcagtaattagactgagtcatattgtttcgaatttccattttttgtggatcttttaagatgctaaccatataagacacttaatttttatatttgtaaattttacctttatttaattaaaagtcctttcatctgcataacaaaaacagtcaatgcattatcaattgtgctttttcattcacagcggaactttcaggactactttttattggagatgcaattctacaggtatacattttatcactatatgtgtggtcaaaacattaactcaatttacaatatgccatgggaaactatgcttttcttttcattgcagataaatggcattaatgtgagaaaatgtagacatgaagaagtggtgagtttactttttcctaatgtcatagttttccccatgtgcaaataagaatttagtgcattgctaaagactgtcacttcattcattaggcagatatgacatttatccagtttgatatcaaattttcaaatgttctcttaatttttttttaaattagaaatagattaacgagtcctatcaaggatgaaatgtgttctgaagaattcttacttaaagatggtcattttctatgtttttccagtttttctatctacccctaccagtcaatgtccattaaatacaccactgggcgaaatacatctctaaatctctgtaaatgtttaaaagcttataaaccatacatttatgcctgtagaatctcacacagtacagtcatccctccctattcatgggatttcacatcggcagattcaaccaaccatctgtagaaaatatgtggggaagaacaataagaaataacaatcaataataaaaataatacaaaaaataatgactattacatagtatttgcattatattagatattgcaagtatctaaagattattttaggcatacaggaggatgtgcatagtttatatgcaaatactacaacttgttatataagggacttgagcatccacgggtgttggtatcctctggggtccttcctggaaccagtcccccacagacagattacctaggaacaaatggaagggcatataaagactgcgtgtgtgtgtagtctgtgtgtgtgagtttgtgtgtttctgtgtgtggggtggtggggagaaagagagagacagagagagagaaccttaacctcaaggcagacaggtttagcaatagacagagtagtcatccagtttttcggcagtattttcttagatttgtgaatgtacagattcccaagccctggaattagatattctaattcagccagtttgggagggcccagggatgtggattttagcaaccggcctaagtgtttccatcataagtggcctctaaattaaacttttagagaagctgaaaggttaaggaacttctgttgggggtggtgaaatgacattaaaaaaatacagaaaggaacaggactgtggtaggcattctaggacatgtctgtcgtggttgaataaatatcattcaaaaacctcactgatttctgtatcagctcctatgggaaagagtagaggataaatcgtatttaaaagtttatactcaaaggtgaaagaaaataagaaatactgtagtccttttgcttgtcacagctctagtttatttggtttttgaatagattgctcctctgttaaaagctatttagagaaaactatgttgatacatttcacatctaagagaggcaacctcaagtgtctgtgaaaagccacggctgcacaagaaccgagacgaaggagggtttttaattaggaacacttggcataactaatcaaggttttttagtatttgtcacttgtctttgtcttcttaaaatcttattggagtcatgctcttgccactctgtgctcaagttcatgtaaaatatacatatttcaattcccaagtttcctacaaatatgtgcaaaaaaactaatattttagaacaagtttgtaaacaagtgagaaaccagcacagcacagagccttctatcttgcagattcctatgtaaattttaaatatagtcacataagcaaagctgcttgtaacttgactcttttttcaaaagtacaaagtgattttaaactcattacccagggagtaaaaccaagtgcattctcttttaaaaccacatgctgttagacggaatgcaatttgcccttcagaggcaggcagcatgcttagacaaactgagatggagctttgattaaacagattagtgcagcatgaaagattagaacgcaccaataattccacttctgaatggttctcattctgttataaaggaaagaaatttgggattgtattgcaaattatatgtggtccttcacaataagcttttatttttttctgagaagcttaactctaccagctttgaaatatgagtactaatatttttatttatttctaatatttcactttccaacagctattagatgctttgtcctcactgcttattagctaagccagtagacttacacctcagtagaacagagatattaattaaatgtttaataatcaacctacaagggcagaaaaaggtataacaagctgagagaatgtaggtggttttgagctagcatgctgatgtaccacatttcttattccaaatagcatgctgatatgccacattccttgtaaaacaccaaattcagaaacaaattgggcaggtatggaagcatgttgtttgtgcatgtaacttttattttatatacctactctattccttgatgttagaaattctgcattcagtctatgatcagctttactgtcaaacagtcttcaaaagtgtaaatgttacttttgtgttggagttatcaggtttgatttatatagaagggggattttacattgttcaggtagtggacagtacctggtgctgtgagcagtaggtgctcagtagatttgtggatgggattctgtaaccaaatgcctagaattagatcatggaagcatttacatctactgtatatatttctcatgggaccagtacgggagtgtaagtgaagtcctggcttcaccacatcacccactgtattcttgctggaagattgttaaggaagagaagctcacagtttcctcatgaaaggaaactagaaccagtgcccagcaccgcttggcatgcagcatggtgcacacatagggcttcaatgctcagaaacaactctgcaaatcatagctcaaccacttacaaacattgtaatttaaggtgaacggaatgaactaaacttttctatcactctattatgtattcataaaaatgaaccattaataaatgttatgggaatgaatgagagtaccatatgtgaaactccaagcatatacctggcaattaattggtaatacattattttgatggcaccaaatgccaccgctcacatgctgctgctcttctccctattccccctccgtgggcactgctgtgtcaaggtgggacagggtctgcttaggagccatgatgggccctggggggtcacacacagacagagccaatgctgctgctcagcatcccatgcttcctccaacaattccagtgaggagttgacatggtcaagagtggcacagcaagagtggcaagactgtgtgaaaaatggggattccttgttcattctagcagtgtgtgtttttattttccatgtgaacacgttttggagcttatgagttgtacctccaagagaccaaagcccatcaaggaaaatgatctattgccactactgatgttaattaacactgatgctattctccttaccactgaaccctagacatattaagctgatggccatctctatatcttgtcatctgtatttttcttttgcttaacaagtaaactgatcacatatcaagaattatctgggccaggtgcggtggctcatgcctgtaatcccagcactttgggaggccgaggtgggcagatcacgaggtcaggagttcaagaccagcctgaccaacatggtgaaatcccatctctactaaaaatacaaaaacattagctgggtgtggtggcatgcacctgtaaccccagctaatcaagaggctgaggcaggagaattgcttgaacccgggaggcggagattgcagtgagctgagatcacaccactgcactccagcctgggtgacagagcaagactcagtctgaaaataaacaaacaaacaaaacaaaacaaaacaacaacaacaaaattgtctgagtggctgggtggcagggcgtggtggctcacgcctgtaatcccagcactttgggaggcccaggagggcagatcacttgaggccaagggttccagaccagcctggccaacatggtgaaaccctatctctactaaaaatacaaaaattagtcaggcgtggtggcgcacgcctgtaatcccagctactcaggaggttgacgcagcagaattgtttgaacccaggaggcaaaggttgcagtgaactgagatcgtgccactgcactccagcctgtcagacagagctaaaaaaaaaaaaaaaaaaaaaagaattatctgagtgccatctatgtgaaaagcactgagactgagtactttctgaggctgagtactttgtgtgataagaaagaatatataaataactgtatatcgctgtaaccttattggtatgtagacatcatttctttagattttaataattgagtatacaaaaattttaagaaaactattagaaaggggcaatatgaaaacaatgtttatttacaatggtctttaacatataacaatggtgatcttcctctcttcactagaaataatagtaaataagatttaactatagcagaaaagtatttgttgagtaaaaagcatcctggttctaataggataatctattcgtataactgaaatttccatctaatgagacttttgaaagagatcatcattaggcaaagcaagatggatgcatagctgattccagaggtttccttttaaagtagcatttctgctttcagacttgagatttatgggtttcaaaaaaaatatgttcatctgctttttgtttctatgattctcatgaatagaatttattaggtaatttgaattgcaaaaattaacacctaattctgaagtcatgattttgaactaaactctaaaaacattcataattctacataattctaaaagaacagactgagtaactaaaagtatgtaatttaaaatgacaccttcatacagtgaaaacaaatgctgataaaacctaatgcaaaaatcctggctaatagcattttgcttgttatgatatatgcctaagtcaatttaaaatttccactggagtaggaacatattcttttttactttagattaatcagacagaaacaatacaagagttataacaaattatctggaaaaaggcataaatttatatattggaacagtctaggaggttttatatgtcaccaaggaacatatttagcatgtgagttgagcacaaagatcattttagattaaaatatcatgaggcacaaatcatgttttacctaactgctaacgattacattgtttacaatctggaaataggttttgagctctaagtgattaatactgccttaagaattctaaccatactggatagtttttctttgaattaacttccaccaaggaaagctatatacaatgtaatttaactttgaatatttctcagtgctctgggaaatgtttagcgcaaagacaaaaggccagaaatgctgtctacactatgtctgcttttgaaaagaaataaaatatccttgccttattttcatacttagctttgcattaatacttttagggatgccttttttgctagacccacatgtccgtcccctgtataagctatacatccagacagcacaggtgacattttaatgactgcatgcttgtactcctgactgctgattcttatcaaatctttatttgtcctcttattttttgagtgaagttgaacaacttagagaactgaaagacccaattttgcaaagctccatctagtccatcccctcagctgtaacaaaatacttgtaactgggtaccttataactaatagaggcttttttttttccctcacagtcatggagactgggaagtccaagattaaggcaccaacaggcttggagtgcactgagggctgctctctgctttaaagatagtgtctttttgcagcctcctctggaagggatgaaagctgggtgggtgctcacatggcagaaaaaatttgaagggccaagtagctctctgaagatcttttatgagagcattaattctgttcatgagagtgaaacactcctgatttaataacttcccaaaagacaccaccacttgctaccaccacaatgggggtcaagtttcaatataaaatttagagggacacaaacattcaaaccttagcaccttctaataatgagacaaaaccaggcctgaaaaaccaattacttaggagggccccagccgatttccttggagaggagtctaaaaacaggatacatctcagaaggcacacctaaaccaggtcaaattgggaggagaaagctggcagggcaggcatgggtgagcctgcaatcccttcacacattctgcaaggatcttctcagacactctcctgtctggggggttggaatgaggaatgcgtgttatacaaattccaaaattttcacatagctgacattttattttcacaataaccagctgatcaaactgaaagccaaggagaagaaaccgtatgacaacggagattttaactcaaggtaaaagttttgtcacactttccactgtttgatgttgataaagggcctcattctgtcttgccctcgtttttctcatctgaaggattaagaggtcgcagtagattattgcttaggtctttttcaggtaaaatcttcagttctttcattgtcaaagaacacaaacatttgttaaagcccacagagctgcagcacacaaagaggaacctctaatggggctaactatgggcctcagtggatgacaacgcatccacactggctcagcgatggtcacaaatgcaccatgctgatgcaagatcttaataagaggggaactctttgtattcctgactctttccgaattctctatcaaaagacaattttaaggccttcccaaggagcaaatgtacaattttaagcaaatgaatacagagatgtgagattaggcaaaatgtttttacttctctccccttttgaaacactttttatatgacaatgaataactctttaaaggtaaaaatcatacagataaaagaggaggagaagagaagacagggggcaagggttgttggtaactttatttaagaatagagagcagatagacaagacggggggaatcctgaagggccaaggggctgtagccaaagccgccatccagcaaacatccccactgcaggcctcagacagcaatcgcgaatgggagtgttgaaaggaagggttgaagaggtgtagccaagaacaggcaatcgaattagagttcaagaggctctgagtattcagccccaggcactgccataagtacagcgaaaggtacattctgggcagtaagtggtctgcgtttgtccttctttcagctctcagaacactggcagccggtttcaccactcagagaagaggtgagaggattcttttttagtgaaattgatctaacagaaataatccacaaatagtacatttggactctcctgttgcaaacagggttcaccctaaaccacacagtggagcccagtggataaaccatgaatcctgtacccaacgctgtcaatttgcttttcagtgtctcactctcaaatattttgtaataccaaaggatcattaagatttgaagaaaatcaaccacatcaaaggcagaagctaaaacaggaaaaaaaaaactgaggaaacagacaaagcaaggtttattgaacaaaaggattttatattgtaatattttcagatagatggtgaaaattaatttgtaaatgaattaatgctaccattatatataaaaggaacatgcagaaaaagaagagctcttggatattaacactttgatatctatcttcaaaaattagattacaaaaatgttgggaaacatctcaaaatggaataaagtagcaaacaagaaggtgatatgacagacaaagaatatgagagatactacattcaataatttttacactgaaccaatggaattcagaaataaaatattacatgaaataaaaggagcatccattatcaaaagaataatacaagaaaaatatccagacttcttgtatatattttccaatagaaacacactaccaattaaaaaaaaataaaagcattttacatgtctacacttgccatgaagtagcatcacattttgatattactttgcattttcctaatgactaaaagtattgaacattttttcttgtgtttgttatatatgccatatcacttttattaattgggttcacttcttactgatttctaagagtttgtttacataatctggccacaagtcagatatacaattcgcaaatattttttcctagtctgtggcttagtctcttcaattacttaatggtattttttgaagcttaaaggttttgactgttaataagtctactttatcaatattttaattttgtcagttgtgcttttggtgtcttagttaataaatcttttcctaatctaaggccatacagacttactgccatgtcttattctaacggttttatagttttaactcttgtatttatgtctaggttcaattttgagttaactttcgtatacagtaaggtaaggtgtcccatttattgagaagactattctttcctattctattgccttgacacttctgttgaaaatgagttgccctaaatgttagagtttatttccaaattcttaatgctgttccattaatttattcacatataccagtattacattcttgattcttgtaactttgtactatgttttgaaattaaacgttggtaagccatcaaactttgttctgtttatatctgattgttaagcaaactatttgtattagaatggttttagtttttatttttattttttatttgagcattttatttgaatcatcataagagaggaggtaattaaaataaaatattcgaatatatatttattttgaattttcatgtatttttctccaaatgaaatataccctttttatgcaaaatgatatacattttttctttttcaacttttattttagattgtggaggtacatgtgcaggttttttacctgggtatactgcatgttgctgaggttttgggtatgaaagacccgtcgctcaggtagtgagcatattactcaacaataagttgttcagaccttgtacccctccttccctcctgcctcagtgtctattgctgccatctttgtgtccatgagtacccgatgtttagctcccacttacaaaagaacatgtagtatttggttttctgttcctgtattatttcacttaggataatagcctccaactctatccatgttgctacaacagacacgatttttttcttttttactgccatataacatttcatggtatacatgcaccacattttctttaatcttcccttggtggggacttaggttgattctgtgaccttgctactgtgagtggtgctgcaatgaacaagtgaatgcgtgtgtcttttctgtaaaatgatttgttttattttggatatatacccagtcatgggaatgctgagccaaatggtagttctattttaaattttttgggaaacctataaactgctttccacagtggctgaactagtttacattcccaccaacagtgtataagcattcccttttctctgcagcctttattaacagacattctgaatggtgcgagatggtatctcctgtgattttaatttacatttctttgatgattagtgatgatggacatttttaaatatgtttgtttgctgcttctatgtcttcttttgagaagtgtctgttcatgtcttttgaccattttttaacagggtcatttgttttttgcttgttctattgttccagttctttaaggactctggatattagtcctttgttggatgcatagtttgtgaatattttctcccattccgtaggttgtatgtatactcttttgatggtttcttttgctgtgcagaagctgtttagtttaattaggtctcacttgtcaatttttgttttcattgcaattgtttttgaggacttagttataaattctttcccaaagccgatgtccaaaatggtattttctaggttttcttctaggatacttacagttcgatgtcatgcatttaactctttgatacatcttgagttaatttttgtatatagtgaaaggtaggggtccagtttctttcttccgcatatgactagctagctattctagcaccatttattgaatagggagtcctttcttgattgtttatttttgtcgactttgtcaaaggttaaatggctgtgggcatatggttttatatctaggttctgtattctggttttagattgacagaaaattgcaaagatactaccaagaattctaatatacccctcacacatatttccctaatattaatatcttttgatattatgaaattattactaatatattactagtaagaaaagtttgcactttattcagatttcattagtttttacctaatggctttttttttcctcttacaggatcccatcagaatacacattgcatttagtagtcatgtctcttcagggtccttgcttttaattttttgatgactttgaaagttttaagtagtactggccaggttgttttgtagaatgtccttcagctgagatttttctggtgtgtgtgtgtgtgtgtgtgtgtgtgtgtgtgtgtgtgtgtgtgtgtgactgtactgggtttatgtggttttccagaggaagaccacggagtgaaattgccattcttatcacatcatattaagagaaaactaccagcatgacttattaccattgataataaccttgattacctgtctgagatagagtttttcagaattcttcattgtaaatgtatttttttctgtccagactatgttttcaagaagtatgtcactatacccaatgccaattatgcagttgaaaactgtgctttactgtgtgagggcaggctatctacataattatttagaattctgttaacatagatttatctattttctcaatttattatttatctgatcattttgataaatcactctggatgcatatatatttattttatactttgggatgtaatccaatactatcttatatattttactggtcaactggttccagttttgggtattgggaactctttctgtggacttcagtgtcacttttaaatactctaatatagtaggatttgctgttgttgttgttattgtttgtttgtttgttttgttttgttttcagcacctcagcttctggcactaacatacttttcaggctgatcttgcatatatttcctgccagtctaagaatcagacatttcccctagaagttctgcttgcctttattagagaatggtactagaaatcaaaatctggattctagatgtgcaaagtagtggtgctttctaggccttctcagctaggaaggaaacatgtgtatacatgcctgttcatatacacatagaggcataccttggtgatactgtggggttggttctagacactgcagtaaaagaccacatattcggtacagtgtactctgctccaatgacaggtgcaccaaaatctcagaaatcatcactaaagaacttacccatgtaaccaaaagccagctgtacccctaaaactattgaagtcaaaataaaaaataaaaagataaaaaagagaatatcacactaaagtgagtcttgtaaattttggtttatgaaaatatctatatggaagtacatatacaagttatatttaaaatatactatagtctattatgcatgcaataggattatttcttaaaaatgtacataacttaattaaaaatatttaattgctaaagacactaacaattatcttagctctcagtgagtcataatctttttgctgggatagagtttgcctcaatgttgatgactactgactgattagagtagtggttactgaaggttggggtggctggggcaatttcttaaaatagaacaatgaaatttgccacatctattggctcttcctttcatgaaaaattttccgtaatgtgatgctgtttaatagcattttgaacttctttcaatattggagtcaactttctcaaatcctgctactgctttatcaactaagtttacataatattctaaattctttgttgtcatttcaagaacgttcacagcatcttcaccaggaagagtttcctttgcaataaaccactttctttgctcttccatacaaatcagctcctcatgtattcatgtgttttcatgacgtggcagcaactcagtcgcatcttcaggttctactctttttttttttttttttttttttttttttttttttttttgagacgaagtctcattgtgttgccaggctggagtgcaatgacacgatcttggctcactgtaactgccgcctcccaggttcaagtgattctcctgcctcagcctcccaagtagctcggactacaggtgtgcaccaccacacccagctaatttttgtatttttagtagagatggggtttctccatgttggccaggctggtcttgaactcctgaccttgtgatccacctgccttggcttcccaaagtgctgggattataggcgtaagccaccacgtccagcccagattctacttctaattccagttctcttgctatttccactgtttgttgttgtttcctacactgaaaacttgaagccctcaaagtcctccatgggggttagaatcaactttttccaaactcctgttaatgttgatattttggcctcacccataaaacagaaatgtttttttaatggcatctagagtggtgaatcctgtccagaaggttttaaatcaacttggcccagatccctcgtaggaatcactatttttggagctatcaccttacgaaatgtatttcctaataacaaaacttgaaagttgaaattactccttgatccatgggcttcagaatggatgctgtgttaggaagcatgaaaacaaaattaatcttattttacatctccattagggctcttgggcgagcaggtgaattgtcagtgagcagtaaccttttgaaaggaatcttattttctaagcagtacgtctcaacagtgagcttaaaatatttagtaaactatgctgtaaacagatgtcctgtcatctaggctttgttattctattcctagagtacaggtagagtagaattagtttaattcttaaagtcgctagcattttcaaaatggtacacagacattggcttcaacttaaagccaccagcagcattggcccctaataatagagccagccagttctttgaagcattgaaaacagacattgacttctcctctctagctatgaaagtcctagaaggcatccagcagaaggctattttgtctacagtgaaaaattgctctttggtgtagtcaccttcatcatttatcttcactagatttcttaataacttcctgcaacttctctatcagcacttactgcttcacctcgcatttttatgtcatggagatggcttctttccttaaacctcatgaaccaacttctgctagcttccaacttttcttcttcagtgtcctcatttctctcacatttcatagcattgaagagggttagggccttgctctggattaggctttggattaagtggatgttgtggctggttagatctattcagacaactaaaactttctccgtatcagcaataagcttgtctcactttctcaccatttgcatcttcacttgagtagcacttataatttccttcaataacttttcttttaaatttacaacctggctaactgcttgtgcaagaagcctacaatttgccctattttgccttccaataccccttcctcactaagtttaataagttctaagttttgatttaaagtgagaggtgtgggaattttcctttcacttgaacacttacaggccatgacagcataattacttggcctaatttcaataatgttgtgtctcagggagtaggaaggcctgcagagagggagagaaatggggaaatgaacagtcagtagaacagtcagaacacacacatttatcaattaagtttgctgccttatacaggtgtgatttgtggcaccctataaataattataatagcaacaactaagatcaccgatcatcaagaggctgatgcaggaggatcacttggactgggaggtggagattaaagtgggctgagatcacaccactgcactctagcctgggtgacagagtggaactctgtctcaaaaaacaaacaaacaaacaaaaaccaaaaaacaaaaaacactgatcacaggtcaccataacagatacaataatatctgttaacatagtatctgttaaataatatctgaaaaaagtatccatttttcaagcagtttgactaactgaaaaagtcaaaatattgtgaaaattaccaaactgcaacccaaagacacaaaatgagtacatgctgttggaaaaaaaaaaaaaatgctctgatagactttctccacacaggcttgttacaaaccttcaatatatgaaatatgtaatatctgcagaggtcagttaagtcaagcacaaggaaacaaggtgtgcttgtatctattcatacacatttctatatgtaactaatattagctactcctgagtttatactgctgtctctaactcaaccctttatcacatgaaacaccacagcctcctccccttgctcatctcattctaacaaatggttatattatctgtcattcatttatttaattgttcaaatctagtatatatgtacagcagtatcagaataagccactccacaatgggaaacaattttatcaggtagagtagaagaattatgctcagtccctttcccctttgtcttacagaccttaagtgaagttgcttcaaacatttgtaacacaataagattctcttgtcacattctgcattttgtcatatctcacaacctcctaagttgtttttattctaagattttcacacactgaagttaactctttgattgtaaattcaatgggttttgacacctgcacagtatcatgtatgtagccactgttacaatgtcatacagaatagtttcactgccctaaaaaatcctctaggatccatttgttcctactatcctggccatggccttcaggaagccatggatcatttcactgtttctgtagtttttcctttaacagaatgccaagtaattaaaattgtgaaaatctagcctttttagattggcttttttcacttagcaaggtgcatttaagatttatgacttttttcctggcttgaaagctctttttgttactgaagaatatcccatcatatggatgcagtataatttgtttatccattcacctgttgaagggcatcacacttgcttctactatttgtcaattattatatgaagtgctataacatttccatgcaggtttatgtgtggacatatttttagaaatcaattggctcagaaggcagtttctgaattatattgagagactatctttagctttgtaagaaactgccaaactgttttccaaagtggctataccattttgtgtatatgcctgtagtaaatgaaagttcctgttgccctacatgcatgccaacattgtcattcattgacataaaaactaagtgtcaagctcaaggttattttatactccactttcttttagaattttatagtattgcattttaaatttaggtctattattaattttgagttcatttttgtgaaaggggtaacacttatatttaatttaatttttattttttgcatatgactttctaatagtttcagcacatttgtcaaaatcttaccaatttcccattgaattgccattgcttctttgttgaccagttgtttatatttatgtggagctatttctggtctttttgttctcttccattgatcatgtgtattcttttgccaacaccatgctgccttaattattgtagcttaattgtaagtcttcaaattgggaaacatgagccctttaactttttctttcccaatattctgttgcaatttaaagtcttttgctgtttcatatacattttaaaatcactttaaaatatctacaaaatagctttttggattttgatgggaatttcattaaattcattgatcagtttgagaaaatcagcatctaagcaatgttgagtcctcgaatccatgaacatggaacgtctattaatttagattgcctttgctctatcagcagagctttgtagttttccacatataattctgtacatatattgctaaattttgacccaggtacatcaattatttggtgttattgtaaacagtattgtttttctaacttcaaatttaaattgtttattgttggtaagtagaaagcaattaacacttgcatattaaatgtctatccttctaccttgctatacttcttcattagttctaagaggtgtcgtgttttgttttggttttgcttctggtagattttttgatatggtgggtttgtctggattgcaaactttgattcatacatgcttaactggaataaatctcatttggtgtgatgtataactctttttatacattattcagtttgatttgctaatattttattcacaatcattgtagctatattcatgagaaatattgctcttaatttttttgtaacgcttttaaaaacttttgtgggtgttaggttaattatgttatcacagaatgagttacaaactgttgcctctccttctgtgttctagacaaaatagtggaggattagtattatttcttcattaaatatgtgatataatttactaacgaaactctagatttcgtgctttctttttgtaatgttattatttattcgttaaatatctttaataaacataggccattttgtattatctatttcttcttgcggaaatttacccagatcatgtaagttatcaaatctgcgggcatagagttgttcacagtgttcctctattagccttttggtatccatgggatcaataagtatgatccctctttcatttctgacactggtaatttgtatctttctctctttatttcttggtgagtttcctagcaatttctcattttctttatcttttcaaaaaacaagcattatgtttcattattttttccctgttgttttttgtgtttgctttccatttcattgatttcctctgtagtttttgttatttgctttctttttactttaggctttgattgctgctttttctaattctgtattgtgagagcttagatcattgattttaaccttctttactaatacatgcattcaatggtttaaatttatctctaagcactgctttgcctgcatgtcacaaatattgataagatgtattttcacttttattgagttcaaaatatttttaaattctcttcagacttcttaatgactcacatgctatatagaagagtactgattaacctccaaatagctggggatttttgaggtctctttattttactgatttttattttaaattcttcattgtctgggaacgtatttgtataataaatatttttttttcaaaaaatagttaaaatttgttttctggcatagaatatagtctgcttttataaattttccatataagcttgaaaaaagtatatgttttgctacctgtaaatggtatattctataaaagtctattataacaatagtactgttcagtccaactgtatttttaaaaaactgctacctgcttgaactatcagtttttgaaaaaatgccattataggctaaaattataataaacatatatttctcctttcagttctatcagtgtttttgccacacatataataacatgctgttgttagattgtctaatattgctatgtcttctttgagattctactggtttatcttacttaattcctcacttaatcattatttcattcccccccttagctttagtaattctccttgctctaagtcctctttgtctgtaattaatatatctcctccagctaccttcattaatgttagcaaagtatatttttctccatctctttaccttaaacctataggagtcttcaattaaaatgggtttcttgtagaagttagagttgggtcttttatattccctagataatctgtcttttggttgcaatatttataccattcaaatataaagttattgatgtaactgaattaatatccaccatgtttgtaatgtttctctatttattgctttggttctttgttcccctcccccactcttttttaacttccttggtttaccttaagcatttgagtaagcccactacatccttctcttattgtatcaattatgcttttgaaaacaattagtgtttgttttagtttccattatgcgtttttaaaaatctgtatgcattttcagatagcactgtgctgcttcttcatgtgtagtgcaggtaccttttaacagaatgttcccaattcctccctcccatctcttatgacattactataatttattttacttatccataatctttaatcaccccacatattgttagtactattattttatacaaagagttaagttgacaagaatgagaaaagcaagatagtttatttacttgcgtttattctttcattggcattctcctttgcttgtgtgtatctgagcttcagacttgtgtcatttttctaatccctgtaggaattcctacatttcttgcagtggagagttcctggcaaggcattttctactattgtttgccggattaagtgtttattcctctactttagaaggacagttttatgggacacaggcttctgttggtgtcgtttttgttttcagcaattgacatgattcacttttttctcctcttgttttcttgggttctaaggagacccagtagtctcaggactgcactccctattcccctgctgcgtgtccacccccaccacggtcagggttccatactgcagtcaggttctgccagcatcctgaaaaccttccagaggcttcccagcatagaaaaaatgagtgcaaagtcattatctgggcttcagcaactccagtattcaaaattcatctaattccttcaccctctaacccagcatgtgccagcccccactcccccacttttgttggggctcacactcaccttaaggcctttgtccttgtcttcttttcctgcatttttctcccctgatctcttcatggtttagattcttgtcattcagaccttagattaaaagcctccttattgcaggcatggtggctcacgcctgtaatcccagcactttaggaggccaagatggtcagatctcttcaggccaggagtttaaaatcagcctggccaacagggtgaaaccccgtctctactaaaaatacaaaaattagccaggcgtggtggcgtatgtctataatcccagctactcgggaggctgaggcaggaaaattgcttgaactgggaggcagaggttgcaatgagccaagatggtgccactgcactccagcctgggcaagagagaggctgtctcaataaataaataaacaaacagttctccttatcacagaaaccttctctggtaagtcacacaatagaagccgtttgccattttgggctgcccagcgccacacaaacattcttatatgagggaacattccaagacaattgggaaataggtccttgtctagaacaacaaaaatgaattgaaggaatataaattcccccattaagttctctacaaaatagaatgttaacaaagcaacaaagtttagccgaacctaatactcccagtaatgaactttaatcctaagaaataagagtgaaatgtcaatatgagattatgttctgtgccaaaatggccaagacattgtgtccagaattggttccttccggtgggttcttggtctcgctgacttcaagaatgaagctgcagaccctcacggtgagtgttacagttcttaaagatggtgtgtctggagtttgttccttcagatgttcagatgtgtctggagtttcttccttctggtgggttcatggtcttcccgacttcaggagtgaagccgcagaccttcgtagtgagtgttacagctcttaaaggtggcgcgtccagagttgtttgttcctcccggtgggtttgtggtcttgctggcttcaggagtgaaggtgcagagcttcgcagtgagtgttacagctcttaaatgtggtgcgtccggagttgttcattcatcctggtgggttcgtggtgttgctggcttcaggagtgaagctgtagaccttcgctgtgagtgttacagctcataaaggtagtgcggacccaaagagtgagcagcagcaagatttatgacaaagagcaaaagaacaaagcttccacagaatagaaggggaccccaggggttgctgcagggggctctggtggccggcgtttattcccttatttggccccacccacatcctgctcattggtccattttacagagagctaatttgtccattttacagagtgctgattggttcatatttacagagtgctgattggtgcatttacaaacctttagctagacacagaatgctgattggtgtgtttttacagagtgctgattgatgcatttacaaactttagctagacacagagtgctgattggtgcatttacaatcctttagctagacagaaaagttccccaagtcccaacccaccccagaagcccagccggcttaacctctcaacatcagtgccacagcataaatgtccaggtgtcagccgtggtagaaacatcccaagcaaggtgtttaaaaatcatataatttttttttttttggagacacccttgctcctatcagagtgtgtttcaatagacattgcttcaattttatgagctaatacctttgcgatatacttatagtctatgtaaattaaaaattgtcatctatgtataatactacataggaaataatactaaatagaaaacagcaagatattactacaaccttattagaatggctacaattcaaaaaatcaagcatatcaaatgctggcaaagatgcaaagcagcagaaactcattcactgcagctagaaatgcaaaatggcacagccactgtggaaggcagtttgacaatttgctaccaagttacatattatcttagcatacaatgccacatgcccactcctaagtatttatccaagataaatacaaacatgtccacaccaaaacatatacaggaatgtttgtagcaggtttattcataaccaacagaaactgaaaccaagaaagatgtcattcaacatatgaatgaaaaagcaaactgtggtaaaatgaaatactattttggaataaaaagaacacagactacatgaccctatatgtagaaatccctaaagagtccataaagcaaagttagaactaataaatttagcaaagttggcagattgaaaattgacacataaaaatcagttggatttctatacactaacaataaactacctaaaaacattaaaggaaattttatttaaaatagcataaaaataaaatatttaggattaaacttaatgaaggaggcaaaatatttttacatagaaaactcaaaaatatttctgaaattaaagaaagtacaagtaaatgggaagacatcctatattcatggactgggagagaatttttattaatacatcagaactacccattgtaatttacagagttggtgtgatctctcaaaattgtgatggtgtttttctgagaaatagaaaactccattctaaaattcatatggaattgcaagagacaccaaagagcaaaagttatattgaaaaccaggaacaaaatcagaggcattacacttcctgattccaaaacttattacaaatctacagccaaaacaatgtggtagtgatataaagacaggcgccacattgtagatgtgatgaagagaatagttagctcagtaaacgattttaaataacattttaaagaccattcaattaggaaacatagtcttttcaacaaatggtgttgggaaaactggatatctatatgtgaaaaaattaaactggaccattgcatcataccatataaaaattaactcaaaatggatgattaaagatctaataagacctaaaaaaatactaaactcatacaagaaaacagagaaaagctttataccatcagattaggcaaggaatttttggatggaacaccaaatcacaggcaacaactgaacagatagataaattgtactaaatcaaaatgaaaaacttctgtgcatcaaaggacacagtcaagagagtgaaaaaggcaacctatggaatggcataaaatatttgtaaatcatatatctgataagaagttaatattcggaatatataaagaactacatttaacaacaacaacaacaacaacaaaaaaccttacccaattaaaaactgtctaaaagacttgaatggacatttctccaaaaaatatacacaaatggccaaaaaaacatatgaaaaaatgctcaacacactaatcgttagggaaattcaaatcaaaaccacaaagtgatattctcaaaccagttaggaatgccactattaaaaacaaaatcaaaacagaaaacaagcgttggcaagtgatatggttaggctttgtgtccccaacctaatctcatcttgaattgcaatccccacgttccccaagtgtcaagggagaaaccaggtggaggtaactgaattatgggggtggttttccccatgctctgctcatgatagtgagtgagttctcaggagatctaatgattttataaagggctctttccatttcatttggcacttctccttcctgctaccttatgaagaagatgccttgcttccccttcaccttctgctataactgtaaaattcctgagggctccctagccatgctgcactgtgagtcaattaaacctctttcccttaaaaatcacccagtctcagatatatctttatagcagtgtgaaaattgacagatacaacaaagatgtggaggaattaggactcctgtgcactattggtggaaatgtaaaatggtatagccattatgaagaacagtatgatggttcctcaaaaagttaaaaacatagctaccatatgatccagagtgtctcctctgggtttatattcaaaagaattgacggcagttgtgaagagatgcttgcaatcccatgttcatggaagcatttttcacaataaccaagaagtggtggcaatccaaatgttcattaacagatgaatggataaacaaaatgtgatatatacttgcaatggaatattattctcccccaaatggaaggaaatccttttacatgatacaacatggataaaccttgatgacattatgttgagttaaataagccagtcacaaaacaatacatcctgtatgaaaccacttatatggggtacctagagtaataaaactcatagaagcagaaaatagaatagtgttttccagagcctgggggaagaagggaacagagggttattgttttaggggtatagaattttagtttttaagtttttttttttcttttccccactggctccaccacagaggtgcaacggctccatggagtctagagtttcaggttttagagttgaaaacattgtgaatgtttgttgcacaacagtttgaatatacttaaaactgctgcacacttaaaaatgattaagatggaagaaaacctaggcaataccattcaggacataggcatgggcaaggacttcacgtctaaaacaccaaaagcaatggcaacacaacccaaaattgacaaatgggatctaattaaactaaacagcttctgcacagcaaaagaaaccaccatcagagtgaacaggcaacctacaaaatgggagaaaattttctcaacctactcatctgacaaagggctaatatccagaatctacaatgaactcaaacaaatttacaagaaaaaaaaaaaacaaccccatcaaaaagtgggcgaaggatatgaatagacacttctaaaaagaagacatttatgcagccaaaagacacatgaaaaaatgctcatcatcactggccatcagagaaatgcaaatcaaaaccgcaatgagataccacctcacaccagttagaatggcgatcattaaaaaatcaggaaacaacaggtgctggagaggatgtggagaaataggaacacttttacactgttggtgggactgtaaactagttcaaatgttgtggaagtcggtgtggcaattcctcagggatctagaactagaaataccatttgacccagcaatcccattactgggtatctacccaaaagattataaatcatgctgctataaagacacatgcacacgtatgtttattgtggcattattcacaatagcaaagacttggaaccaagccaaatgtccatcaatgatagactggattaagaaaatgtggcatatatacaccatggaatactatgcagccataaaaaatgatgagtccatgtcctttgtagggatatggataaagctggaaaccatcattctgagcaaactatcgcaaggacaaagaaccaaacaccgcgtgttctcactcataggtgggaattgaacaatgagaacacatggacacaggaaggggaacatcacacactggggactgttgtggggtggggggaggggggagggatagcattagcagatatactgaatgctaaatgatgagttaatgggtgcagcacaccgacgtggcacatgtatgcatatgtaacaaacctgcacgttgtgcatatgtaccctaaaacttaaagtataataataataataataataataaaaaagagcatgcagtggcaaaaaaagaaaaaaaatggttaagatggaacattttatatgtagtttctcacaattaaaatttttttaaaatcatgacaaatcacataaaaattcagatatgtggctcttcatttaaaaatcagaagctctggaaactttgggcctccactgtttctcaggtatttcacagattccagttatcctcctccttgtgcatttgcctacctgacttctgtagattcctgaatggcaatgctgaaatggccaaatgccagagtcagatgccatttccgtgtgttccttcgcatgctatagtagatcccagtaaaattcaaccacatcataagcatctctttaccggcctcccagtaaaaccaagaggcaatggtgacaataatgctgtctttcacaccatggtttgtgctcctagagtaatgcctggtaaaagcaagataactaaaaagtttgctgaatagaaagatttccaaaaaaaatcattttagaagtttggaaaatcccagagtggaaagaaaatgtgacaacataatataaatgcattacaaagaaagtgctgactttggaaatgaggaaaaattgtagattaaaggcaaataaactgcataaatactatacagcagtcccctccttacccatggtcaacgatggtacaaaaacgtgaagtggaaaacttcagaaataaacaagtcatacgttttacattgtgcactgctctgagtagcatgactggagcactgctccagtcccccatggacttgaattatccctctgtccagcatatccagattgtatacactacccacccgttagacacttagtagccatcttcattatcaaattgactgtcatagtatctcagtgctgttttcaagtcgccctaattttacttaattatggttccaaagtgcaggagtaatgatgctggcatattattataattgttccatttttgttattagttgctgttaatatcttactgtgcctagtatatcaattaaacttattcatagttacatatgtacaggaaaaacatggtatatatagggttttgtactatctggtgatttcaggaattacctgagtgtcttggaacatatgccctttgaataacggaggactactctactcagctgataaagttgtttttcatggattatgggttaaaaatttctgaaactgctacacatgtacactgtatttgaactattaaaacatactggatggcagagctaagtttctcactgttggagtgggaggttacaaataagcaaggggaaaagattagaatggtctgtgtggtaatggataggatacagttggggatgtccttatgagctcctgttttgcctaaattagatataagtcattgcacatagaaacatttatacacttatgtaaataaacaggtttataaacctactagatttttcttgctgtcccagctggagggcttagaaggtactgtcacttcagtggaaatgagcacacctagtacctagatcttggtatctaatacttttctccagtaaagagaaatggatgattcaaggactggggcaggacatacacaaaatgagcctgtgacacacacagacacacacacacacacacacacacacacagagggataaacatacacacacagtattaatagggcatgtcaaaggagcaaaggagccaactgaaagaggccccaatggccaaagctgaaaccatctgaacaagaaaataaatcaggtaatattggattttaattcattatatgaaatacatatctatgagtcctcggtgacatagatgattgaatcattaaactggggaagaaaagaaaaatcagtgcagaacaatttcaaataattcatgcagataagctgtactcatggaggtgaagtatgacttgccacttcttaagtatgggctgtccattctgacttccttatgaagaatgaagtatgaaaaggaggggtggggagaggaaatttagcgtgtagaaatgtgacatcacggcctcagcaagtttatcaaggataatatccacaatgagagtcctatcaatagcatgtacacttgatgtgatatgaggaaaatgaccctttatttctgtggtccccttccccagatcacatatacctagtctaattatgagaaaaaaaatcagaaaaaaatacaattcaggaatatactacaaaatacctgaccaatacatctcaaacagttaaggccttcaaaaaaaagaaaatctggagaaattgtcaaatccaaaaggagcctaaatagacagaacaactaaatgtaatgtaatatcctggatgagatcctggaactagaataaagacattaggggaaaaactaaggaaatctgaatgagctatggactttggttagtaagaatgcatggatactgactcattaactgtggcaagtgtaccatagtaatgaaggatgttcatataggaaaccggatgtggggtacatgggaactctctgtgctgtcttttcaagtttctgtatatctaaaactgttttaacacaaccattctatttttacaaacaattcatttgtatttacaatgatctcatatttttccttttttgtttacttttatttatttttctctctctcctctctggaatgtcagctcttcgagagtgaaagttatttatcttttattcaaagtgttgtgtattgatataatgctaatgggcaatacatatatgggtacaatgaatgaaatactgaaataccctctctgctgtaatctagatgacccattactttcagaaagagctctcctcctctcctatagattttgcttcattcttcttttctgttttcaaataatcctctctactttcatattcatctggcatatcagctcttctaccagcttcaggaaggaacctccagacagcagcccttggtttacctatgtttgtatacagaaaaccatgagattaaaggtggatcaacacaatttggatttcaacctattttgaaaatattcctttaaaaattatttggactttaagtcatccctaatatatttctatacttgatgctttaggattaatcttgtattatttttaatgacaggtttttggattccaacatatctattcatgcatattaccaattgtagatttctgaataagcaatacaatttgataagctaaaagttccttcttgttcccaaaattcccagtttattatcaatcgtttcactctgctaaccactgaagccacttcctaatcactagtttttgtttttcaattctagcatttctgggataactcctcttttgctataagttgtaaactgtatccattggacatatattttcaaattttctttccttctctttctgtgagtaaagtagtgcatgtgtgtggctgaaactatctttgtttttcttagggattcatcttattccagacagctctgttatttaaatgttgggtatgttctggagtttgtattgtggtccttgaaatgagaaagcaaatgggtacatatggtcagatacttttaagtctatttcactggagttccatatatttattgaataattttgttgaataaaatatttctcttataggaatacatagacatcccataataaaacattttatatgaaattcctcttattttaattaatctaatactttttcctgtaacaaaaggtaatatttattaagtaaatacaaacttccaagctcctctctaagtagtaaaacacataatcttcataaaactgctagatagatatgattattactattatttcatagatgagaaagatgcaatgcggagagattaaatcaattgcccagggatatacagctgtcaaactatggaaatagaattaaaactaatagaatctagctcccaagcccaaattttaacaagtacatgccatttgaagaaagtagtttggggatgattttgtgataataatctttcttctgagaatataattggaattaaaacacttggcttttttttttcttcaagaatttaatagaacttgggcattgagggactcttgtaattatccagctttctgccaagaatttgaatctcatctgatgccacgtttctgactgtttttaagcgttccaaatctgtggtgtgtagtgtgttaacagaaaaatgctttctttcctacagaatttgaaattaattttcttagtgcctgtcttctgcttacttccccaatggggaatattctcggtttctttcttttcccattgacactttcctccacattcttaatgcctttgatgcctcatttagctcctcacctacacagaatttgatttcacagggcctgagacttgtccatcccagctttattccaactctgcctgagagcccttcctctgcactcactgtggagtctagcctttggtctagcacagggtggactctgggcccctgtgccttcctcctcttcagctgtcccccatattggtggtggtgggtttctaccgtttcatgttgcctcacactcccctgttgaagttttccaagacatctcatgttaaattaccatttgaaaaacctgaattgttttctattgactagatcctgacaattacaaaggtttgtcaatatttcaagttttcctgggctcttaatgaatgctgctgtatttctccttgaagaggttcagtaaatgttagttgattaggataataaattggataagaaaagatacaaaaatagacacaatatcaactgtggagactttaaaatagtgagaccttgtctaactgaggatagagcacctctggctagaattacatgtcaaacatcttgaaatataatacttacaattttaaaataaaaatgttaaatcatcagttttaacatctcaagggttttgctgtaacaatctttagtaagtcactctcctcccaccttcttgcatttaccccacctgaattttaattcgctctgattgtggagcttaaaattagtgatgggtatggtcatcgtctttttcttttttgagattttttccaacatgaacaaatttaatgtgaggaccagcctgtaatcaggtgtgtgtagtctctttcggaatgaatggggcattgtcattcgatgacttgagatatctcaaaagtatacaaggagaaatatgtgtaaggccactgtaatggctggagttataatgcttggtttatttaaatttattttctgtttagctggagagctgctcaggctaattaacaagctcccgacatgtagcatcacacaatccaaggaagtaaatggaaacaaattgctaactagtgctgaaataattagagtagtattgtcttttggcgtgaaaatgttaacaacataaaaaagtccaccacacattagtaatctttaaagtgtttctttcacagtgacccaatgttgaaggtttggtcaaatagggttttgtattctttacaaaattatatttggatgatcagatataaactatattgcatgatttaataataaattgggaaaatattttgactttcacaacagaaatcagcctatatttaacaatattaaatatttcattgaaagaattacaggttgtgaaaatgaaagaatgaacagttgtttttattgggatgtagctcaaatagaagactcaaaactataattaccacactatttttattaaaaacaagcattgaatattcagtgtacacatagtatcctcttgtatataaaaagtattactaaaagttgtttcttgccataaataactttatcatttaaggtggcagcacccacaaaacaaggcagtaatagtttgaaggcaaagctgataaacatacagcacaggctgggcgcggtggctcacgcctgtaatcccagcactttgggaagccgaggcgggtggatcatgaggtcaggagattgagaccatcctggccaacatggtgaaatcccgtctctattaaaaatacaaaaattagccgggtatggtggtgggcacctataatcccagctactcgggaggctgaggcgggagaattgcttgaacccgggagacggaggttgcagtgagcggagatcacgccattgcactccagcatgggcgacagagtgagactccatctcaaaaacaacaacaacaacaacaaaacatacagtgtaaagtattattaggttctacagtggacaatgtgtaacatttgctttatttggggatttttatactatctccctataattgtgctctgtatattcaaggaatgtgaagattttatgtttagtgagtagcaaataattatgaccacagcaagtgaaatttaaaaacttaactgttctatgttaagaaaagcactgagattgcattttaaggacaagaggactgcactttggatttctattactctagatgtcatgaaataaatcatattgattttagatacttttcctcatcaataattggaataaagttatgtacttctacttatatcaaggaatgttttgatgattggtgtgaaaaatatctatgaaatccttttacgtctctttcactaatcaatatcaaaaagaacaatgcttcattgctcttaatggcttcccttaatgtgtaatgttttttgttactaatcagttttgtgatttctgcagagtcatggaagtgagacagtcagtcccagcagtgaatggaaacagttctggtcctggattttcagccctgcatgcaacatgttatggacatatttattcagtccccggtttatgaagtgaacataggaacagaatcagcagagctgtagccatttcccagtccagtgatctgacaaattgctgccctaatcaatctgtcaagatgtgtctgtcatgcctcctctttcctcccactaagttgtagctgtggactagctctgtctggaggctctgctgccccaggttgctatggagaccacagtgatagtagatatgaaagtaaaagctgctctttttcctcctcttcttactaacaaacgtgaactgctatcctaccctagagtccaaatataactgaggcaggtagggtgagaatgacgggacttcaaaggcatgtggggcttcctttctaatcctccatatgggcaggaagcccagcttccccgtccccgcctacttaccacctgctttgcaaaggaaatgtttgtgagaattaccctcagtagtttttgtaacactgtctcatttgaaagtattacatgtgagttctcacactctcattgtgagtttgcaaactcccaatgagcactcattcctctaaaatctctaacagaacataacccatttcaatcttaggtctgaagtaaatagcctacagattataaaaatcagcaatcatttacttcaattcatttagagagtagagagacagagcttgaattccccgtttctacaccattgccgaggacacatagatgcaaggattctaggcaagtggcctctgaaaaatgcaattatgaaacatgagggggctaatactttggctccaaactatgcctaatatatggccattgatatgtgtactccttacctggaggtttctttgcattgagataatgatgtatttagtttggaggagagttggtatgatgctgacatctgagcctgaagctcagagcatgaacacatgaaattccccaaagatgttttatttattgatttttcttattattcagataccaggtgatgggaatgccctttgggactctcttggaaaagaagcaaggcttgaagtagaatagtagactagaaagaggtctgagataaaatagaaaggtgacaatattataattttaagggttatttttagatatttgcactaattttcatataagtaaaatgggggcataaattacttccaactatgtattaaatattgaacagtctcataatgtacatgcatcttgcacaatttgataaatatcttagtgatttttatagttatcctatgtctgacatttttgtgcatagcagacctctctgaaggctgaaatttaaagtgactatgaagtgatagaatggatctatgtattttttttcatgtattaagcaacatataaggcagacaattttctccctacccattttttaatacattatatttgggatatacacatccgtttttaagtgtttaaaattactggactctcaaagaaaccactgttttctcttggtggtacagctgtgtttctccctatgcaggcttcagtcatcatgaaagtgctagcacagctcactccatggtggccccaacaatgctgctaatggtatcagggtatttatattgtactcagtgtatatcaaaggggatggcatttaaaattcagaatagcatgttcaaatgactcatgcagtggacggaaatgacagtatatggcagggaacagtgtaagcaattctacaatatttacttcttagttacatgttgtgcaaacattttgtgataatacgcataaacaaatatttagcaactgtattctgcagctgcaaatctaatgtgggtgtgataggggttagctttgtttttcagatcttgataattctttatgcttgaaataacctatacaaaattctattaaaataaggataagtgctatgtattatttctttttcttcacaaattctacttaaatgtggtacatagttttcaagctaaacatttatatagctatggttttactattatgaatttagagtgaatatgtgtataagttatttccatctaatgtggttatatcaaatatgtatatatgtatgaggctttaagtaaacattctggattttctttctttcttttctctttttctttctctctttctttctctctttctttctttctttctttctttctttctttccttctttctttctttccttccttccttccttccttccttccttccttccttccttccttccttccttccttccttccttctttctttcttttttttttatggagtttccactcttgttgcccaggctggagagcaatggcacagtctcagctcactgtaacctccacctcccaggttcaagcaagtctcctgcctcagcctcctaagtagctgggattacagtcatgcgccaccattcctggctaattttttgtatttagtagagatggggtttcaccatgttggtcaggctggtctcaaactcatgacctcagatgatctacctgtctcggcctcccaaagcgctgtgattacaggcgtgagcctccatgcccaacctggattttcttgatatagacatgttctctacttcagtatcctgcctgtataagaaatatgcagggcctggcgcagtggctcatgcctgtaatcctagcactttgggaggccgaggcaggtggatcatgtgaggttgggagttcgagaccagcctgtccaacaggaagaaaccctagctctactaaaaatacaaaattagccacacgtgatggtgcatgcctgcaaccccagctacttgggaggctgagacaggggaatcgcttgaactcaggaaggggagatttcagtgagccgagatcacgctgtcacactccaacctgggcaacaagagagagactccatctcaaaaaaaaaaagaaaaaagaaaagaaaaagaaagaaatatgctataacctttcagtctgtaaaatatgtcttgtctgcccatctgcaagatttgaactgagtacacttcatttcatgcgcaatgattgcattttataaatatactctctgccattgaaggaaggtggagggacattcaacatgggtctgaattaagtattttggggcctcagtaaacatgtgattacatttgatctgataatggaaactttgctcatttgaggaagtcattggtggtctctgagatatgaccaagagggcactgtagaaccttgtggaaaaacggctgggaccatcaggttgtgtgggcagggttgcccaggttttgttggtttccttgtttgttgtatcacactaagcaacgagacaactgtaccacatttcagtgatgtcagtattattagcacagaggccaaaaaaacactttgaatccttttatgcagactagatttgggccagggttttttacataatgctatttacttttaaaaacttctcttatacttttttttccttttaactggttgtaaatatttgtcttcccaccagcttagaagtctctagaacttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatacctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctgtccccattgcttgtttttctcaggtttgtcaaagatcagatagttgtagatatgcggcgttatttctgagggctctgttctgttccattgatctatatctctgttttggttactgtagccttgtagtatagtttgaagtcaggtagtgtgatgcctccagctttgttcttttggcttaggattgacttggcgatgcaggctcttttttgcttccacatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttctaagttggattcctaggtattttattctctttgaagcaattgtgaatgggagttcactcatgatttggctctctgtttctctgttgttggtgtataagaatgcttgtgattttttgtacattgattttgtatcctgagactttgctgaagttgcttatcagcttcaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctatcttgtgccagttttcaaagggaatgcttccagtttttgcccattcagtatgatattggctgtgggtttgtcatagatagctcttattattttgaaatatgtcccatcaatacctaatttattgagagtttttagcatgaagcgttgttgaattttgtcaaaggccttttctgcatctattgagataatcatgtggtttttgtctttgcctgtgtttatatgctggattacatttattgatttgcatatattgaaccagccttgcatcacagggatgaagcccacttgatcatggtggataagctttttgatgtgctgctggattcggtttgccagacatttatgcagccaaaaaacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattccttagagatctagaattagaaataccatttgacccagccatcccattactgggtatatacccaaagtactataaatcatgctgctataaagacacatgcacacgtttatttattgtggcattattcacaatagcaaagacttggaaccaacccaaatgtccaacaatgatagactggattaagaaaatgtggcacatttacaccatggaatactatgcagccataaaaaatgatgagttcatgtctttggagggacatggatgaaattggaaatcatcattctcagtaaactatcgcaagatcaaaaaaccaaacactgcatattctcactcgtaggtgggaattgaacaatgagaacacatggacacaggaaggggaatatcacactctggggactgttgtggggtcggaggggggggagggatagcactgggagatatacctaatgcttgatgacgagttagtgggtgcagtgcaccagcatggcacatgtatacatatgtaactaacctgcacaatgtgcacatgtaccctaaaacttaaagtataaaaaaaaagtccagtaaaaaaaaaaagaagtctctagaactaaagggctttatcaactttatttcttcattgcttattctgtgttacctcatatggtgttttgaatgtgatagatatttgatatatgtttgctgagttaatttaaactatgcttctggatctcaaaagaaaatatacacaagtaagtaacttaaacaaatggagtcttattaatgtggaaagaagctacttagtccattctatcttgttttctgtatctaggtagagtcttccttctcagaactagggctgcgaagtggtgctgtgcagctgggctctatagataaagacgcatgaagaagttgatagatgatgatcatcctgaaattgctatgagagtaaaataggttttttttaagaaattctgcaagatttgccactgactattttaagaaaatggcacagtggaaaaaatggagaactcacgtttacatgtagttttatttgtcagtctgccacatattaggtgctatgtttgagcaagtcactcagtttttcaatgtttccatagagtctagcatgccctttacctaagtatctgtatggcaaatatgcttacctccttctatcccttggtcggaaatcctatcaatgggtcctaccttcactgatctatttaaaataactctccacacagctctgctcttgcttgtctgctctgcctgccattttccttgcctatgagcacctctcaacgtctccctttctgggcttgcatattgtttacttcatgctcacctaatgtctatcctccatcatctgttcctgccccttgaaaatgagcactaggcaatgaccatgatgacagcaagccatgttattgacagacgggttccaagagcccagcatgacacttggcccataaaaagtattcactaaatagtcattaataaataaatgtaatgtagtctttttttattacactttaagttctgggataaatgtgcagaacgcgcaggtttgttacataagtataaacgtgccatggtggtttgctgcacccatcaacccatcatctacattaggtatttcttctaatgctatccctcccatagccccccaccccacaacaggccccaatgtgtgatattcccctccctgtgtccctgtgttctcattgttcaactctcatttatgagtgagaacatgtggtgtttggttttctgttcctgtgttagcttgctgaaaatgatggattccagcttcatccatgtccccacaagggatatgaactcatccttttttatgactgcatagtattccatggtgtatatgtgccacattttctttattcagtctatcattgatggacatttgggttggctctgtctttgctagtgtgaacagtgctgcaataaacatacgtgtgcatgtgtctttataatagaatgatttctaatcctttggttatatacccagtaatgggattgctgggtcagatgatatttcttgttctagatccttgaggaatcaccacactgtcttccacaatggttgaagtaatttacactcccaccaacagtgtaaaagtgttcctatttctccacatcctctccagcatcttctgtttcctgaccttttaatgatcgccattctaactggtgtgagatgatatctcattgtggttttgatttgcatttctctaatgaccagtgatgatgagcttttctcatatgtttgttggctgcataaatgtcttcttttgagaagtgtctgttcatatcctttgcccactttttgatggagttgtttgttttttcttgtaaatttgtttaagctctttgtagattcaggatattagccctttgccatatggatagattgcaaaaattttctcccattctgtaggttgcctgttcataccgatgatagtttctttggctgtggagaagctctttagtttaacccaatttgtcagttttggcttttgttgccattgcttttggtgttttagtcatgaagtctttgcccatgcctatgtcctgactggtattgcctaggttttcttctaggattttcatggttttaggtcttatgtttaagactttaatccatcttgagttaatttatgtgttaggtgtaagcaaggggtccagtttcagtgtcctgcatgtggctagccagttttcccaacaccatttattaaatagggaatcctttcctcatttgattgtttttgtcaagtttgtcaaatatcagatggttgtagatgtgtagcattatttctgaggtctctgttctgttccatttgtctaattttctgttttggtactactactatgctgttttggttactgtagccttgtactatagttcgaaatcaagtaacatgatgcctccagctttgttctttttgctcaggatcgctttggctatatgagctcttttttggttccatatgaaattgaacgtagttttttctaattctgtgaagaaagtcaatggtagcttgatgggaatagcattgaatctataaattactttgggcagtaaggccattttcacgatattgattcttcctatccatgtgcatggaatgtttttccatttgtgtcctctcttatttcctcaagcagtggtttgtagttcttcttgaagaggtccttcacctcccttgtaagttgtattcctaggtattttattctccttgtgcaattgtgaatgggaattcactcatgatttggctccctgtttgtctattattggtgtacaggaatgcttgtgaagtcaatatttgaaagcaacaaaaattgtcctgaaggttaaaaccgtaaatccacattggaggaactgcaggggcaggggccccgggcagcccagccccaggggtaggcaggcaatggctcctttagctgacctgaggtgcctgcagcgggacttcctcagcctctatccacttgacctcgaccttgcttgtggacctggcaactccagcctgggcctgggtcccacgtcctgagactgccttagctcagatgctcctgctccgccaggtcctcctcaaggcggctactgcttctggcactgcagatagagtggtagcatataatgtataatcaacgaatttcaagacaattttggagctggaacccaagcctatcaatcatgtctacattgctcagacaagctctgcatcaggagactggaaaagccatgcttggaaaccttggacacagagagcgacctcacagatggaacagcaaggacgtgacacagatgtccttggcccagggcccttcctgccccgctggggatgcagccaccacgggttctgccgggaacctctgatcccaagctccccagagtttacacgtgacctggagacacacctcggacagccaacaattcagtattttgaatcagtcgggacaaaacaacgtgacagtatcagaatgacgtaccttagaaagaatgacatattcctaggcctctgggagtttgcgacaagtacttaagttgtacactttattattggaaagcttcatgtacgggaaagaaaacagccaagacaaacacaaatgcgtttttgatggatatggataaaggggaaaccaccgttccaatgttcaagcagtgattccatccgaagactacacaagacgacagaaagccccagcgagtgagccagccgccggacaacagcaatgtccttcctgactatcgcggagctggcggtcagcagccccttagctcccatgcccatcggagtacgtgcgcagcaggcaagggcgaccccgtggaaggacgcgggctgagcttagaggggcacccagcgctgctggagccgcccatgctgcaaatgctgtgctgtgatccagaacttatttatttatttatttatttatttatttatttatttattttactttaagttctggggtacatgtgtggaaagtgcaggtttgttacataggtatacttgtgtacttgtgccatggtggtttgctgcacccatcaacccatcatctacattaggtatttctcctaatgctattcctcccctagctcccccgcccccctaccacccgcaggccccagtgtgtgatgttccccttcctatgtccacgtgtcctcactgttcaactcccacttatgggtaagaacatgcagtgtttcattttctcttcctctgttactttgctgagaatgatggtgtccagcttcatccatgcccctgcaaaggacatgaactcatccttttttatgactgcatagtattctatggtgtatatgtgccacattttctttatccagtctatcattgatgggcatttggattggttccaagtcttagttgttgtaaacagtgcctcaataaacatatgtgtgcatgtgtctttatggtagaataatttatagtcctttgggtatatacccagtaataggattggtgggttaaatggtatttctagttctagatccttgaggaattgccacactgtcttccacaatggttgaactaatttaccttcccaccaacagtgtaaaagcaagcgttcctacttctccacatcctctccggcatctgttgtttcctgaattttttagtgattgctattctaaccggtgtgagatggtatctcagtgtgattttaatttgcatttctctaatgaccagtgatgatgagcttttcttcatatgtttgttggccacataaatgcctccttttgagaagtgtctgttcctgttctttgcccactttttgatggagttgttctttccttgtaaatttgtttaagttctttgtagattctggatattagtcctttgtcagatggattgcaaaaattttctcccattctgtaggttgcctgttcatgctgatgatagtttctttggctgtgcagaagctctttagtttaatgagacgtatttgtcaattttggcttttgttgccattgcttttggtgttttagtcatgaagtctttgcccatgcctatgtcctgaatggtactgtctaggtttccttctagagtttttatggttttatgtattacgtttaagtctttaatccatcttcagttaatttttgtataaggcataaggaagggatccagtttcagttttctgcatactggtaccaaaacagatatatagaccaatggaacagaacggaggcctcagaaataacaccacacatctacaggcatctgatctttgacaaacctgacaaaaacaagcaatggggaaaggattccctatttaataaatggtgttgggaaaattggctagccatatgcagaaaacagaactcttaagatagtagaatatacggaaatacaaacggggattttggagcatgatggtacaaccaattccaactttgttgtaatttttaaaattctggcaccttctatgcatatgatcctttagatgatatattctgtacagaggaagaaccagatcatccaaccaaaaacaaatgaatggatgccttacatattcctgaatgaacttttgaagagcttttgagaggctgacttcaaaccgtttaggaaactacatggaaattgtgcagacttttctgggacttttctaatgtttgtaatactgtatttaggttcttttcctattttcttttaaggagtacatttggaaatttaaaacaattggcaaaccttcaattagtgtattaaatgcaggagacttctgtattttgggcaccttcctaatacgctttatcatttagcactttgacttgagtggtgttgattaaacatttgaccagtaactatgtttttataaatctactgtacaaattatacagagtttaagatttaagatacagcttctaaggtcaacgctgtatataagtgtataatttttaaaaaagattttgtacatggaaattttctatttatatatataatattttttacttctatatattgagagtatttagtatacttttatataaataaagacaactggtaattgctgaaaaaaaacaaaaataataaaaccatgtcaaatacagtcaggtaccaaataaagataaccattatctccattatttttcaacaaatttgatgagttccagcaaatacaggtaaataaaaaattgaaatttcttttagaaatattaaagagagccctaagttggagggttgcgggggatatgccagggaatttttttttctattcctacttttcttagagttttcattaggaattgctgctcaatttgaccaaacatcctttcagaatctttaattgaagggagaaacatgtatatatgtatatatacacacacacacacacacacatatatatatacacatatatatatgtacacacacacatacaacttgttgaggaaattaattatattcataataattcatggatatttattcaggatttctcttttgaaataaagaccacttgctcatagcaaaatttcatttctcacttgctgaattccatatgctaatactgtattcaaaatacagtattggcatatgtatttatattaataattgtctcgtttattttatttatactaccacatctgcctttatttttaattttcatttaaatttactttaataaaatggtttgaagatacatgattttctactggaatcatctcttctttaagaattaggtaaaactcagttttatcactctgttcctgatgctttttcaaagtagaacttttatcaattgtaaaatttaaattaactttattaatggatcttgagctactcatttggccacataacaatcaaaagaaaaaagaaaatgttgcttgaatcattgaggaaatcatcttggaattacaacaaatgctgaaatagtgtttccatagccacgtgaactacctaataatgtattttacttcaattagtttaactcagaatgatatgtctctttatacacttttattacataaaatcttgttttaattgagtctttgaaaacaatgaattattttcagtcatagccttaaatattgtcattaccttaaataagtacaattttatcaaatgtttcaatattcttttctaactaaaataggtggctcttttctatattgaaattcagtgatttattattattgtattatgattagtttcactaagatttgttatttttattagagctgagagctgaaactgcattcttaattgtaataaataattatcaaaatcaaacattattgcataattatacattattttaggctgaaattttaggaattgtgaaattttaggaattgtgaaattttaaactattcatagttctttctttcatcatataaccagatggaccttcttgttgggacttttcattttaaacgacataaaatttagactagaaatgcctattgaaagattcctatgtcatttctacatatttatgaagtatttttaaaaattaaaatgcagaaaaaaataataaagtgaatgaatacatacaatgcctccccaggaacatcacattaccttccttgaactattatgttgacgataatctgactccccatccctaatgtgatgtatttctagcttttccagctctgtcctgtatcctgtggttgcagcaaccaagatgagagctgatgtgactcaatcatgtcaaattcttttttttttttttttgagttatttcctccacgttcccaattatatttgacttcacatagttgattaacccactacttccaaaagttatgtgataaggttttcttagatgcagctctataccctactttccagctgggtaatttctgctgctacacttgatttactttccaatccaacagtaacagctcttgtgaatattacagactcatttcttgctcaaatgcttctctcttaagaaggccttatctcctgcccatggctagcaactgccatgaccctgtgagcaatctgcagttgtgaatgtatatacctgcaggaaaccacagaagggtagtatgctccctcaccctgccaccagaagactcctctggaaacatgaatgtgctggtagacacacaaatggcaggaggactccctaacactggcatgaaagcctttacattaccgtttcaaccaaagctgtcacccagtagttcctgtaaaaagccaagttcttatttttccttcagttcgtaaatgactgcataaaaaaagatacatttatttggtttccacgtatagtcagtattttagagtgaacagtaaagtgtgttatagtttctagattagcctagttattttatctgtaaagtgacctgtttcaaaatcaaccctcaaagtcatgtttaagatccttttcagataggatccagaataagaaaataatttactatgtcaagtgggatgagtccaatatctaagtgaccgttttccatcattgttactggcgggcagaaatacgtcaatctgactctcttaagatcaaaatcttacttgattccctgacatcatatgaggccagttaactatgatcctcacaagctaatcttcctgcccttgctgtctgtgaagggaggtgtgtgcgtgtttcctgatgtgtgcttaaaatatgcctagacaaagcagcagtgccctctttttatcaattaaaagcaagctcagctatgggtatccttggctttatattgcagagcagtggcaggtagctaaattcctccttagaatctcatagacgttagaatggcctccaagaggaaaccagaaagggcaaagaaccaaaaaatgttgtatgaacttttcttcttaatagatgaatggaacttaagagctttcagttcatgaactgagtcattagatttgtagtggttttaatattaaacacataaatatctatttgaatttaatttctcttttctattcttattgattgtcaccatttatcaaccctcttgcttgggtactcatctatagcagtttgagagaataactgtgctaatactttatctgattaaaattcacaacattttatttgaattatgaaatgtgagtgaaagtaaaaaggacaactggatttattggttatttcttatttggcaggaataattcgttcattattattcaagatatagaacctgtattttccaacctgacagtatcagtctgatataatatgcatttaaagcatagaagaaaaattgaaaaaaaaaacactatctcaatcctattccctgaaaagattaataagcctgcattaattaagaaatgtgtatttgtcaaagacttaaaattatgattacacagatactcataagtgaccttatattttaaaaactcattatctctttagggtgagattttattattgtttaacgttcttatatttttcacttatacttgaaaaaaactttaagattgaagcacaaatataaagctttaaaagtaaagcaactgcccagtgcctatttcataggcaaccatatttaaccaatacatgtcatatttttcccatatctatacccatatttacatattcccatatttatatacttattcaaaattgattttcataccattatttctttttgtttaatcctagatattatctattgtacacttaatatagaatatgagtacttagctattttttccactgccccatatattttaatttatcagaaattcccaatagagtcacataatattgattatatcaatatatagaggttataatataatgtcaatacaaatacataagccaagttcataaattcattctaagccaaaaaaagcaaaagaaaaaacactggaaatttcaatgagattgtcctaaatctatagaaaaatagggcagaattgttatcttcacagtactgtgtccagcaatccatgacatagaatacccaccaacacaatcaaggtaataaaatactcatttaccctaaaagtttaatcttgccactgtataatctgtccttctgcctcttctcttctccccattccctgaacaatcactaatctgctttgtggcgctatacatttgtttacattttctacaattttatgtaaatgtaatcatataatagtatgttttctggcttctttcactaaatataattattttatatttattcacctggtatcatgtacccatcactcattgctttttttcttgttatgtggagtcacattccattataaggatatatctcagtttgtctacccatttactttttgatggacatttgagttttctaaattttctgattaaaaatacagctgctatgaatattcatgaaaagtatttgtaagtacatttactctgatttctcttggataaatttctaaaaattaatttactagatcatgtagtatggcttgtttcaattttatgaaattgctaaattattttccaaaatcattgtgacattttcagttttaattcttagtctctaagcattccagttcctccaaaaccttacacacacttagtatgtgagacatacataatttagacatttcagaagatttatagtggtatctcattatagttttaatttacatttcactaattgctattatgttaagcatattttaatgcactaatttgccttgaacataagttcaaggatatacctgcctaagatttttcctcatgttttattaggcgtttgtattattattgagttttgagtgttctgaaacatattccaagtatatattatttatcagaaaaagatttacaaatattttctcaaagtttgtgactttcttaaaagtatgttgcatagaaaagaatggttcaattttgattactcccaacttaacaatttgtgtttttattggatgtacttttggattaataactacaaaaataaatcctgccttaatgccacaacggttttctccaaagtttacttttagaagttttataagcttagactttacattcaggtaattgattcactctgagttagtattagtatgtcgtgtaaggtatagctcaaagctccttttcttttctaatgaggatttgaaatagttccagcacaatttgttaaaaagattttactttctctactccattgcaacattgttgaaaaattgttgtttatttttgtttgcatttatttctggacatatattatattaattatattacattatatcatgttacattattattttattttgctttatctatctttttgataacacaatgtcttgatgattatagtttctttatatctcttaaaatcaaacgatgttggtttaatagctttgctttgattttccaaaggtggtttggttatcctggattttttaaatttccacatgaattttaataacagtttgtcaatttttataaaaaagtctgctgggatttccatatgggtttgataaatattgagtcttgtgacacatatatttaaatgtttaaaaattactcatagcaatgttttgtatacagggcttttactacttttgttagattgatacataaatatttcatggttttggtgattttatagtttttttaaactagaaattctgattgtttataaagaaatgtgattattttatatttatcttatttcctgaaactctgctagaaagattagttatgattagttccaggagctttttttttttttggtagattctagtgcactttttgtaagccatcatgtcatctgcagatagaggcttttattccttctttccaaatatagatacctaaattttttctctatattgtcctgcctagtacctttatggaaatgttgactaaaagtagacagtgtggacactcttttattttttctaaacttaggtcgttaaggcctttagtcttttactatttagtaatgatattacctgtaggttttttttttatagcttccctatgccagtttgaggaagttccgttctaccattactttgcttaaagtgttcaacagatatgaattttgaatattgacaaatattttttgatatttcaacttaggtttttatgtggttaattacaccagttgatcttctaatgttaaaccaaccttgtattcctggattaaactccatttgatcattttgtattatctgatttgcattgatcatgttgtattgtttgatttgttaaaatatttaataatgtttacataagtcctttatctggctccttttaaaagttttaaaagtttgttcctttttatctttagtttgcaatatttttattatgatgtgtcttagcgtagatttatttggcaggattcttttgaggtttgttaagcttcttaaatctgtgggctcatgtctgtcatccaattggagaaattttcagacattatatgtttaaatattctttcagtccctcttctttctcctctcctctatgactcatatgatatgcattttatacattttgttactatccttcaggttactttttcttttttttttttggtctatatactctattgttcagatagggtgaattctattattctgtcctcatctttgttaattctactctctctcattcctactttgttattgaactattcccaagtgattttaaaatttatgaaaaaatatttgtataatatctatttggatattataacataacttttttggctgaaattttataatttttcacttgaatcaaaaagcttgtaatttcttatggcaacatttttgttgattgcttcaaaatccttgtcagagagttccaatatgtgatttatctcattggcattagtagattatttcttccctttaaaattgtgatttttctgattctcaatatgacatatactttttactatatcctggtcattttgtttattatattaggtgactctgcctcttacttgagatttctttttttaagcagaaatttaccgtttagctcacgggtttgtggtccatggttccatttacaatatatgttttagagctgtttggtgctgctttgttctgactgatttatctcgtgtcactgggcacccactgttccctgctgggattgtttgaagggatggaaaaagctttcccaggtcagtgctggttatggagggttcctccctgctgtagaggaggtaggataatggggaccttggagcaggtctatctttgctggtactctccactaggatggtgtctctaggcagaggaggatagtctcaggaccttgacaaagtggcctccctcactgggcacgtatgaggaggtacccctgccaatgatcctagttacacagtgcctctgagtggggcagagtgttctgaggcccagggggaaggctagcacttctgctggcttcccgttgtcaccgctcactgatgtttgctgccttgcctggtattagtgcggctcctttacaatccagaggtggtatgagcctatatagcgtgctttctgttttaatgatggggctgagaaagtgcccggcctgtttggtgttcctctggtggagcaggtaaggtatccggcctctgtgctgtccagtgctggcctgagaccccaatcagattttccttctccttctgtctttcagagttcttatttggttgtcttttgtattttcttcagtgtttacagttgtacttcttggggaggagcagagagagatgagcctgtgcgtttttttttttttttttttttttttttttcacggagttttgctcttgctgcccaggctggagtgcaaaggtgcggtctcagctcgctgcaacctccgcctcccaggttcaaacgattctcctgccttagcctcccgagtagctaggattacagacgcctgccacgaagaccggttatttttttttattttttttttttttttttgtatttttagcagagacggggtttcaccattttggctaggctggtctcgaactccagacctcagatgatccacctgcctcggtctcccaaagtgctgggattgcaggcatgagccaccatgcccagccatctgtgccatcttgtcagggccagaagtcattctaaattggtttcaagtagccaattctttaattgcggttgaacaagttttctatgtatttaacaagatatatttccatgtttattaactgctttttcactgattattcttgtctcattttacatgatagtttaaaattataaacatattaatatctttttcaggtgtgtttgctataagtaactcttcaacttcttgttcttttaattttttttaaattttaaaatttgcacatggcttatatttttggatatgattcttggagaaattgaaattattttaactggaagaactagacttactaattctgtattttaaaaaatgttgagagttattgataataacagacttcaacattatattacaactgatgctattgataataacaggtttgcaggggaaagaaaagaaaatattaagtagaatatgtaatgcctatttattttttgcaagaggattagagtgaattgggtcaatttgctttaatctgaattagtactctggtcaatattggcagaatcagatttttatgcttttcgaatcattttctcttacatcttagcttattttatgttacataacatatgctccaaagcttatccaatttattggtgcaaaataggtgctcaacaattattaataatttaccaataaatacagtgacctgaacattctatctgcctttctgtggacttcttgattcctcatattgcctaatatagagcataaactcaggaagacctcaacaagtatgaatggaagattcacgttgtgtataaacaggtgatcacagaatgtgacaagaggatgaacattgatggctcttactgcaatgataaataattagctccctctatcttttataaaatgtttctgaatactagggaaaaatggaaggtggaagaaacaaccaataatttcaaggctttgccatcatataacatgataaatgtaatgatgattgtattctttttattctttttttcaggttcaggttcttcggaatgctggagaagaagtgactctaacagtgtcatttttaaaaagagcacctgctttcctcaaactcccattgaatgaagattgtgcatgtaagcatttataaagaatagataaaagtgctcacatcattatagttacataattattattttgacaataattggtgatttcttcttaaagttgagatttttgcctgactgtaaacatttttatattacaaagtgttctactaacctttatgaaaagggaacagatgttatttttcttgaagaatagattcaccacattacagttttttctaacctacaattggagaagtattatttgttttaaaaataggcatatcaaatatcatgtatgcattatgcatgtctattaaatttcatcagaatatttggtgaatgtattttctctaactaaaaattaatactaaacaagaatatgtgcttaagttattctgatgagagaagatgaaaaaaagcgtttgcctttgagggaatgtactaatttacatagaactacttaaaaagttatttgtcaattttattttcatgttccattttctaaaatgaaatgtatattatctaatgcttttgctgaaaaattgaagaataatatatgtttcactgagacataatttgtatgcaataaaatacaaagatcttgcacagtcggatcagttctgaaaaggcacacatttgcttaatccacttcttacaatcataaaactgttcccagtaaataacagcccagaaatgactactcacttacactctcttcttcatacattattttgcctcttctagaactttacagaatggaattatacttaattttttattctggcgtctttcattatgaataatttccttcagattcacttatttcttagattcacatatttcttagtttgttcatttatattgctgtttattttgctgtttattattccattgtatgaatgtactacatttattaatgcatctttctgttgaagataccagcactgttcccagtattttgctataataaataaagctgctggaaacgttcttttatttaacttttattttaagttcaggggtacaaatgcagggttgtaacataggtaaacttttgtcatgggggttcgttgtacacaaaccagttattgaaattagtacccattagttatttatcctgatcctgtccctcctcccaccctacatcccactgaaaggccacagtgtgtgtggttctcctctatttgtctatgtgttctcatcaaatagctctcacttgtaagtgagaatgtgaagtatttggttttctgttcctgtgttagtttgctagggataatggcctccagctccatccatccatgtccctgcagtggacatgatctcgttcttttttatggtgacatagtattccatggtgtatatgtacaacatttttgttatccagtctaacactaataggcatttaggttgattctatgtctttactattgtgaatagtgctgcaatgaacatacacatgcatgcgtctttataatagaatgatttatatgtattgggtatataccatttgacccagcaatcccatcactggaagcttcttgtataaggcttttggcagttttgtaattttattttattacaataagtacttaagaattgaattgctgagtgactagaaagatgtataattaacttgttaataaattgccgaatttaggtggggtgcagtggcccatgcgtgtaatcccagcattttgagaggctgaggccggcagatcacctaagctcaggagttcaagaccaacttgaacaacatggcaaaatgccatctctaccaaaaatacaaaaaaaccccaaaatagccaggcatggtagcatgtgcctgtggttccagctacttgggagtctgaggtgagaggatggcttgagcctggtaggctgaggatgcagtgagctgagtaagaccccatctcaaaaataaataaataattaattaaaataaataaattgtgaaatttatttccaaagtgagcatgttatttattgtggtaaataacacataacataaaatttaccatctttaccattttaagtgttcagaagagtagccttaagtctatgtacattattgcgtaacatatcaccagaaacttttgatattgcaaaatggaaattctataccccttaaacaattccctattttccccagacccacccactggcaaacaccattgtattttgtttataagaatttgactactttagacaccttatgcacttggaataatccagtattttcttttggtgattagcttatttcatttagcataatgtccttaagactcatctatgttgtagaataggacaaaatttcattcctatttaagaatgaataacattctttcatatgcatataccacatattctttattcagccctcaaacagtgagcatttagattggttccacatctttgttattgtgaataatgctacaatgaacatgagtgtacaaatatcattcacaactctgctttcggttattttggatacatactcagaagtgggattcctggatcatatgttaattctatttttaattttttgaagaatgaccatactgttttccatagtagctgcatcattttacactcttaagtaacaggcaaagcttccaatttctacatatcctcaccagcacttcttattttctgtttttttgctttgttttgttttggttttgatagtggccattctaattgttgtcagatgataattcactgtggttttgatttgaatttccctgataatcagtaatcttaagcgtcttttcacatatttattggccatttgcatattttctttgaagacatgtctattcaagtctactatccagttttaaatctggttatttgttttgctgttgttgagttgtaagaattcttcagatactctggctattaacgtattaccagacatatggtttgaaaatattttctcccatttcaaaggttgctgtttcactctgttgatcattttatttattttacaaaatttttaattcttctgtagtcaagtctatttttgcttctaatgcctgtgtttttggtgtcatattcagaaaataattgccaaatccaatgtcataaagatttttctctaatttttctgctaggattttttacagctcaaatctaatgtttaggtatttgatttgtgttgagtcaatttttatacatagtataaggtaagtgcccaacattcttttgcatgaggatatccagttttcccaatataattaattgaagagaagactattctttccctattgtataaccttaacatgtttgtttaaaataatttcatcacatattgagggttaattttgggattattccgttccattgttctatgtgtctgcattaatgccagtaccacattgtttttattattgcagctttgtaatgtatcttgagttcagaaagtgtaaagccccagctctgtttttctttctcaagaatttttgactattcagaattcgttgaggttttgtatgaagtttaggatagtttttctatttctgcaaaataataccatagagattttgatagggattgcattgaacctgtagattgcattgcttagcatgaacattttaacaatattaattcttccagtgtatcagcatgggatgtctttctatttatttgtttcatctttaatttctcaatgatattttgtggttttcagtgtaaagtctttaaaattttgggtgagattattcctaattattctttttgatgctattatcaataaaattgtttttttattgttaatggatagaaacaactgaatttttatgttgtctattctgcaacttccttaaacttgtttattagatctaacatttttgtgtgtgtgtttaaactttagagttttctacatataagctcatatctgcaaacaaagataattttacttcttcatttgaatttgggtgacttttatttcttagtcttgcctaattgcttctggctagaacttttggttgtatgttgaatagaagacttgagagtgggcatccttgccttattcttaatcttagagggaaagctttcagttttccattattcagtataatgttagctatgggctttttatatatgaatgacctttattatgtagaggtaatttccttctattcctagtttgtaaaatgtattatgttttaaattgtgaaaatattgaatttggcaaatgcttttttcttcatcaactgaggtgtctatgtgggatttttttttctgccattctgttattgtgatgtgttaattacatagatagattttttttcatgttgaaccatccttgcatttcaggaataagtcacacttgatcatggtgtataatcttttaaatttgtagttgaattcagttttttagtatctttttgaggacctttgcattaatattcatcaggaatattggtttgtagttttattttttgtagtatctttgcttggtttcagtatctgggtaatgttcacttcaagctggaaactgctttcccctcatcaaatttttttgaaagagtatgagaaagatcagtgctaattcctctttaaatgcttggtaaagttctacagtaaaaccatctggtcatgggcccttcgtattttgtgaggaatttattaatgattcaatttccttactagttctatgtctgtctgtattttttgtttcttcataattgattgttggtatgtcacatatttctagaaggttatctattttttctagattattcagtttgttggcacataattgtccatattactctttaacaatcattttggtttttgtggcatcagttgtaatgtctactatttcatttctttttttttaattatactttaagttttagggtacatgtgcacaacgtgcaggttagctacataagtatacatgtgccatgttggtgtgctgcacccattaactcatcatttaacattaggtgtatctcctaatgttatcccttccccctccccacacccccaaacaagccctggtgtgtgatgttccccttcctgtgtccatgtgttctcattgttcaattcccaccttcatttctttttttttattatactttaagttttagggtacatgtacacaacgtgcaggttagttacatatgtatacatgtgccatgttggtatgctgcccccattaactcatcatttaacgttagatatatctcctaatgctatccctccccactccccactcccctcaacaggctacggtatgtgatgttccccttcctgtgttcatgtgttctcactgttcagttcctacctatgagtgagaacaagcagtgtttggttttttgtccttgcgataatttgctgagaattttatggtttccagtttcatccatgtccttacaaaagacatgaactcatcattttttatggctgcatagtattccatggtgtatatgtgccacattttcttaatccagtctatcattgttggatatttggcttggttccaagtctttgctattgtgaatagtgccacaataaacatacgtgtgcatgtgtctttatagcagcatgacttataatcctttgggtatatacccagtaatgggattgctgggtcaaatggtatttctagttctagatccctgaggaatcgccacactgacttccacaatggttgaactagtttacagtcccaccaacgatgtaaagttttcctatttctccacatcctctccagcacctgttgtttcctgactttttaatgatcgccattctaactggtgtgagatggtatctcattgtggttttgatttgcatttctctgatggccagtgatgatgagcattttttcatttgtctgttggtggcataaatgtcttctttcaagaagtatctgtccatatctttcacccacattttgatgggattgtttgtttttttcttgtaaatttgtttgagttcattgtagattctggatattagccctttttcagataagtagattgcaaaaattttctccccttctgtaggctgcctgttcactctgatggtggtttcttttgctgtgcagaagctctttagtttaattagatcccatttgtcaatattggcttttgttgccattgcttttggtgttttagacatgaagtccttgcccatgcctatgtcctgaatggtattgcttaggttttcttctagggtttttatggttttaggtctaacatttaagtctttaatctaccttgaattaatttttgtataaggtttatggaagggatccagtttcagctttctacatatggctagccagttctcccagcaccatttattaaatagggaatcctttccccattgcttgtttttgtcaggtttgtcaaagatcagatagttgtagatatgcagcattatttctgagggctctgttctgttccattggtctctatctctgttttggtaccagtaccatgctgttttggttactgtagccttgtagtttgaagtcaggtagcgtgatgcctccagctttgttcttttggcttaggattgacttggcgatgcggactcttttttggttccacatgaactttaaagtagttttttccaattctgtgaagaaactcatcggtagcttgatggggatggcattgaatctataaattaccttgggcagtatggccattttcacgatattgattcttcctacccatgagcatggaatgttcttccatttgtttgtatcctcttgtatttcattgagcagtggtgtgtagttctccttgaagaggtccttcacatcctttctaagttggattcctaggtattttattctctttgaagcaattgtgaatgggagttcacttatgatttggctctctgtttgtctgttattggtgtgtaagaaggcttgtgagttttgcacattgattttgtatcctgagactttgctgaagttacctatcagcttaaggagattttgggctgagatgatggggttttctaaatatacaatcatgtcatctgcaagcagggacaatttgacttcctcttttcctaattgaataccctttatttccttctcctgcctgattgtcctgtgcagagcttccaacactatgttgaataggagtggtgagagagcatccctgtcttgtgccagtattcaaagggaatgcttccagtttttgctcattcagtagactattggctgtgggtttgtcatagatagctcttatttctttgagatacatcccatcaataactaatttattgagagtttttagcatgaagggttgttgaattttgtcaaaggccttttttgcatctattgacataatcatatggtttttgttgttggttctgtttatatgctggattacattcattgatttgcatatgttgagccagccttgcatcccagggatgaagcccacttgatcatgttggataagctttttgatgtgctgctggatttggtttgccagtattttattgaggatttttgcatcgatgttcatgagggatattggtcttaaattgtctttttttgtcgtgtctctgccagcctttgttatcaggatgatgctggcctcataaaatgagttagggaggattccctctttttctattgattggaatagtttcagaaggaatggtaccagctcctctttgtacctctggtagaattcaactgtgaatccatctggtcctggactttttttggttggtaagctattaattattgccacaatttcagagcctgtttttggtctattaagagattcaacttcttcctggtttagtcttgggagggtgtatatgtcgaggaatttatccatttcttctaggttttctagtttttttgcgtagaggtgtttataatattctctgatggtagtttgtatttctgtgggatcggtggtgatatcccctttatcattttgtattgcatctatttgattcttctctcttttcttctttattagtcttgctagcggtctatcaattttgttgatattttcaaaaaaccagctcctggattcattgattttttgaacagttttttgtgtctctatttccttcatttctgctctgatcttagttatttcttgctttctgctaactattgaatgtgttttctctggcttctctatttcttttaactgtgatgttagggtgtcaattttagaactttcctgctttctcttgtgggcatttagtgctataaatttccctctacacacagctttgaatgtgtcccaaagattctggcatgttgtgtctttcttctcattggttttaaagaacatctttatttctgccttcatttagttatatacccagtagtcattcaggagcaggttgttcagtttccatgtagttgagcggttttgactgagtttcttaatcctgagttctagtttgattgcactgtggtctgagagagagtttgttataatttctgttcttttacatttgctgaggagtgctttacttccaactatgtggtcaattttggaataggtgtggtgtagtgttgaaaagaatgtatattctgttgtttggggtggagagttctgtagatgtctattaggtctgcttggtgcagagctgagttcaattcctggatatccttgttaactttctgtctcattgacctgtctcatgttgacagcgtagtgttaaagtctcccattattattgtgtgggagtctaagtctctttgtaggtctctaaggacttgctttatgaatctgggtgctcctgtattcagtccatgcatatttaggatagttagatcttcttgttgaattgatccctttaccattatgtaatggccttctttgtctcttttcatctttgttggtttaaagtctgttttatcagagactaggattgcaacctctgcctttttttgttttccatttgcttggtagatcttcctcgatccctttattttgagcctatgtgtgtctctgcacgtgaggtgggtttcctgaatacagcacactgatgggtcttgactctttatccaatttgccagtctgtgtcttttaattggagcatttagcccatttacatttaaggttaatattgttgtgtgtggatttcatcctgtcattatgatgttagctggttattttgctcgttagttgatgcagtttcttcctagcctcgatggtctttacaatttggcatgtttttgcagtggctggtactggtttttcctttccatgtttagtgcttccttcaggagctcttttagtgcaggcctggtggtgacaaaatctctcagcatttgcttgtctgtaaagtattttatttctccttcacttatgaagcttagtttggctggatatgaaattctgagttgaaaattcttttctttaagaatgtttaatattggcccccagtctcttctggcttgcagagtttccaccgagagatcagctgttagtctaatggacttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatttgaatgttggcctgccttgctagattagggaagttctcctggataatatcctgcagagtgttttccaacttgattccattctccccattactttcaggtatatcaatcagacatagatttggtcttttcacatagtcctatatttcttggaggctttgctcgtttctttttattcttttttctctaaacttctcttctagcttcatttcattcatttgatcttccatccttgataccctttcttccagttgatcgaattggctactgaggcttgtgcattcatcatgtagttctcgtaccttggttttcagatccatcaggtcctttaaggactgctctgcattggttattttagttagccattcatctaattttttttcaaggtttttaacttctttgccatgggttcgaacttcctcctttagcttggagtagtttgatcatctgaagccttcttctctcaactcatcaaagtcattctcaatccagctttgttctgttgcttgtaaggagctgtattcctttggaagaagagagtcactctgatttttagagtttccagtttttctgctctgttttttccccatctttatgattttatctacctttggtctttgatgatggtgatgtacagatggggttttggtgtggatgtcctttttgtttgttaattttccttctaacagtcagaaccctcagctgctggtctgttggagtttgctggaggtccactccagaccctgtttgcctgggtatcagcagtggaggctgcagaacagcggatattggtgagcagcaaatattgctgcctgatcgttcctctggaagttttgtctcagaggagtacctggccgtgtgaggtgtcagtctgcccctactggggggtgcctctcagttaggctactcggaggacagggacccacttgaggagacagtctgtccattctcagatctccagctgtgtgcttggagaaccactgctctcttcaaagctgtcagacagggatatttaagtctgcagaggattctgctgccttttgtttggctatgccctgcccccagtggcggagcctacaaaggcaggcaggcctctttgagctgcggtgggctccacccagtttgagcttcctgggtgctttgtctacctactcaagccttggcaatggcggatgcccctccccagcctcactgctgccttgcggtttgatctcagacagctgtgctaacaatgagtgaggctccgtgggcataagaccctccaagccatgcgcaggatataatctcctggtgtgccgtttgctaagaccgttggaaaagtgcagtattagggtgggagtgacccaattttccagatgctatctgtcacccctttctttgactaggaaagggaattccctgaccccttgcacttcctaggtgaggcaatgcctcgccctgcttcagctcacgctcagtgcactgcacccactctcctgcacccactttttgacattccccaatgagatgaacccagtatctcagttggaaatgcaggaatcacccgtcttctgcatcgctcatgctgggagctgtagactggagctgttcctatttggccatcttggctccccctgcaatatttcacttttaatttttatttgcatattttacttttttttattagcctagtcaaggtttcgtcaatattgttgatcttttcaataaaccaactatttgcttagttgattttctatactgtatttcttttttccactttatttatttctgctctaatctttataatggctctccttctgctaccttgggtttagtttgtttctttttctagtttttgaatggtaaaatttggttgctgatttgaggtttttaaattattttgcaacataatgctttaaaatacatatgtttactgataaaattttctctctttgtaatgcttttgctgcatcccatgaatttttgtatgttgtgtttcattttaatttgttggatattgtttaaaatatttttaagtcccttgtgatttctttttgacttattggtttttcaaaacttcattgtttaatttccactcatttgtgtatttttcagttctctctctgctattgatttccattttaattccattgtatcagaaaagatatttgatatgatttcaatcttcttaaatttaataagatttgttttgtgaccacatatgtaaactattagggagaatattttgtgtacacataagaagaatgtatattttattattgttgagtgaagtgttctgtatatgtgttaagccaaattagtgcttagtgtcacacatgtcctccattttgttattctttctgtgtagtggttctataaattagtagcagttgaggacttaaatgtcatactattattgtgttgctgtctatccctttaattctgtcaaagtttgcttcatatatttggatatttggctgttaggtgcctatatatatttataattgttatatcttcatggtgaattgacagttttactattataaaatatctttctttgtgaaggtttttatagttaaagtctatttttgtctggaataaatatggtcactctgctcccttttatatcatttgaatgaaatatttttctctatcatttcattttcagcctgtgctcatcattaaatataaagagagtctgtagttgacagcatacataagcatatcttggagatattgccggtttagatccagatcagcaaaataaagggaatatagcaataaaacaagacacacaaattatttggcttcttgttgcatataaaagttatgcttattcttatattatagtctatcaaatgttccataacggcattatgtgtaaaaatacacataccttaatttaaaatattttatgctaactgggcagccatttgggcagacaacaagctagctgcaggagttttttttttttttttttttttttttttgttactccagtggatcctggaatgccaatgagacagaaccattcactcccctggaaagggggctgaagccaaggagccaaatggtgtagctcagcagatcccacccccacggaccctagcaagctaagatccactggcttgaaattctcgctgccagaacagcagtctgaagttgatctgggacactcaagcttgatggggggaagggcgtctaccattactgagcctttagtaggcggctttctcctcacagtgtaaacaaagttgctgggaacttctaacagggtagagtgcaccacaactctgcaaagccactgtagccagactgcctctctagattcctcctctttgagcagggcatctctgaaagaaaggcagcagccccagtcaggggcttatagataaaactcccgtctccctgggacagagcacctgggggaaggggcggctgtgggcacggcttcagcagacttaaacgttcctgcctgccggctctgaatggatctcccagcacagagtgcaagctctgctaaggaacagattccctcctcaagtgggtccctaacccccatgcctcctgactgggagatgcctcccagcagaggtcgacagaaacctcatacaggagagctctggctggcatctggcaggtacacctctgggaagaagcttccagagaaaggaacaggcaacaatttttgctgttctgcagactccgctggtgatacccagcaaacagggtctggagtggacctccagcaaaatccagcagacttgcaacataggggcttgattgttgggagaaaaactaacaaacagaaagaaatagcatcaccatcaacaaaaaggacatccacaaaaaatcccatccaaaggccccatcatcaaacaccaaaaatagataagtccacaaagatgaggaaaaaccagcacacaaagtctgaaaattccaaaaaccagaacaccacttcttctccaaattatcacaactcctcaccagcaagggaacaaaactggatggagaatgagtttgatgaattgacagtagtagtcttcagaaggtgggtaataacaaactcctctgagctaagggatcatgtcctatcccaatgcaaggaagataaaaacctttaaaaaaaggttagaggaattgctaactagaataagtttagagaagaatataaatgacctgatggagctgaaaaacacagcatgagaactttgtgaagcatgcacaagtatcaatagccaaattgatcaaatagaagaaaggatatcagagattgaagattaacttaatgaaataaagtataaagacaagattagagaaaaaagaatgaaaaggaatgaacaaagtcttcaagaaatatgggactatgtgaaaagaccaaacctacatttgattggtgtgcctaaaagtgaaagggagaatgaaaccaagttggaaatcactcttcaagatattatccaggagaacttcccctacatagcaaggcaggccaacattcaaattcaggaaatacagagaacaccacaaagacagttatcaagaagagcaatcccaagacacatagtcatcagattcaacacggttgaaatgaaggaaaaaatgttaagagcagccagagagaaaggtcgtgttaccaacaaagggaagcccatcagactaacagcagatgtctccgcagaaactcaacaagccagaagagagtgggggctaatattcaacattcttaaagaaaagaattttcaacccagaattacatatccagccaaactaagctccataagcgaaggaaaactaaaattctttacagaaaagcaattgctgagaaattttgtcatcactaaatctgccttacaagagttcctgaaaaaagtgctaaatatggaaaggaaaaaccgataccagccactgcaaaagtataccaaattgtaaagaccatcaatgccattaacaagctgtcaaataacaggcaaaataactgggtagcatcatgacaggatcaaatacacacataccaatattaaccttaaatgtaaatgggctaaatgccccaattaaaagatacagactagcaaattggataaagagtcaagaaccactggtgtgctgtattcaggagacctatctcatgtgcaaagacacacataggctcaaataaagaaattgaggaatatttaccaagcaaatggaaagcaaaaaaaaaaaaaaaaaaaaaatagcaggggttgaaatcctagtctctgataaaacagactttaaaccaacaaagatcaacaaagacaaagaagggcattatataatgataaaaggatcaatgcaacaagaagagctaactatcctaaatatatatgcacccaatataggagcatgctgattcataaggcaaattcttggagacctacaaagagacttagactcccagacaataatagtgggagactttaacaccccactgtcaatattagacagatcaagaggacagaaaattaacaaggatattcaggacttgaactcagctctggagcaagtggacttaatagacatctacagagctctccaccccaaatcaacagaatatacattcttcttagcaccacatcacacttattctaaaattgaccacacaattggaagtaaaacactcctctgcaaatacaagagaatgagaatcataacaaacagactctaagatcatacggcaatcaaataagaactcaggattaagaaactcactcaaaaccacacaactacatggaaaatgaacaagctgctccagagtgactactgggtaaataacaaaattaaggcagaaataaataagttctttgaaaccaatgagaacaaagacacaatgtaccagaatgtctgggacacagctaaagtagtgtttagagggaaatttatagcactaattgcccacaagagaaagcaggaaatttctaaaattgacaccctaacatcacaattaaaagagctagagaagcaagaccaaacaaatttaaaagctagcagaagacaagaaataactaagatgagagcagaacttaaggagatagagactcaaaaaaaccttcaaaaaatcaatgaatccaggggctgtttcttttgaaaagattaacataatagaccactatccagaccaagaaagaagaaaagagagaagaatcaaatagacacagtaaaatatgataaaggagatatcaccactgatcccacagaaatatattactactatcagagaatactataaacacctctatgcaaataaactagaaaatctagaagaaatgggtaaattcctgaacacatacaccctcccaagactaaatcaggaggatgtcgaatccttgaataggccaataacaagttctgaaattgaggcagtaattaatagcctaccaaccaaaaaagcccaagaccagttgggttcacagccaaattctaccagaggtaccaacaggagctggcaccattccttctgaaactattccaaaccattgaaaaagagggactcctccctaactcattttatgaggccattatcatcctaatactaaaacctggcagagccacaacaaaaaaagaaaattgcaggccaatatcactgataaacattgatgggaaaatcctccaaaagcaactctcaaaatgaatccagcagcacatcaaaaagcttatccaccacgatcaagccggcttcatccctgggatgcaagcctggttaaacatacacaaatcaataaatgtaatccatcacataaacagaaccaatgacaaaaaccacataattatctcaatagatgcagaaaaggccttcaataaaactcaacacccttttatgcaaaaactctcaataaactaggtattgatggaatgtatctcaaaataaccagagctatttatgacaaacccacagccaatatcatactgaatgggcaaaagctggaagcattccctttgaaaaccagcacaagacaaggatgccctctctcaccactcctattcaacatagtattggaagttctggccagggcaatcaggcaagagaaaaaaaataaagatattcaaataggaaaagaggaagtcaaattgtctctgtttgcagatgacatgattgtatatttagaaaaccctattatctcagccctaaatctctttaagctgataagctacttcggcagagtttcaggatacaaaatcaatgggcaaaaatcacaatcattcctatacaccattaatagacaaacagagagccaaatcctaagtgaactctcattcacaattgctacaaaagaataaaatatctaggaatacaacttacaggggaagtgaaggacctcttcaaggagaactgcaaagcactgctcaaggaaataagagaggacacaatcaatttgaaaaacattccatgttcatagacagggagaatcaatagagtgaaaatggccatactacccaaagaaatttatagattcaagctaccattgactttcttcacagaatttgaaaaaaaactactttaaatttcatatggaaccaaaaaagagcctgaatagccaagacaatcctaagcaaaaagaacaaaactggaggcatcatgctacctgacttcaaacaatactacaaggctgcagtaaccaaaatggcatggtactggtaacaaaacagacatacagaccagtggaacagaactgaggccttagaaataatgccatacatctacaaccatctggtctttgacaaacctgacaaaaacaagcaatggggaaaggattccctatttaataaatgctgctgggaaaactggctagccatatgcagaaaactgaaaatggacctcttcctaacaccttatacaaaaaataactcaagatggattgaagacttaaacgtaagatctaaaaccataaaaacccttgaagaaaacctaggcaataccattcagggcataggcatgggcaaagacttcatgactaaaacactaaaagcaatggcaacaaaagccaaaattgacaaaagggctcaaattaaactaaagagcttctgcacagcaaaagaaactataatcagagtgaacaggcaacctacagaatgggagaaaaaaggcaaaggctgatatccagaatctatgaggaatgtaaacaaatttacaacaaaaagcaaataatcccatcaaaaagtgggcaaaggatatgaacagacacttctcaaaagaagacatctatgcagccaacagacacatgaaaaaatactcatcatcactggtcattagagaaatgcaaaacaaaatcacaacgagataccatctcacgccagttagaatggtgatcattaagaagtcaggaaacaacagatgctggagaggatttggagaaataggaacgcttttacactgttggtgggagtgtaaattagttcaaccattgtgaaagatagggtggcaattcctcaaggatctagaacgagaaatacaatttgacccagcaatcctattactgggtatatacccaaaggaatataaatctttctactataaggacatatgcacacatatgtttattgcagcagtatttacaatagcaaagacatgcaaccaacccaactgcccatcagtgatagactggataaagaaaatgtggcacatatacaccatggaatactatgcagctataaaaaatgagttcatgttctttgcagtgacatggatgaaactggaaaccatcattctcagtagactaacacaggaacagaaaaccaaacaccaggttctcactcataagtgggagttgaacatttgagaacacatggacatagggaggggaacatcacacaccaaggcctgatgggggctgggggtctaggggagggatagcattaggagaaatgcctaatgtaggtgatgggttgatgggtgcagcaaaccaccatggcatgtgcatagctatgtaacaaacctgcgtttcctgcacatgtaccccagaacttaaagtacaataaaaaataatttttgctaaaacatgctaagaatcatctgaaccttcactgatttgcagcttttttgttagtctctctattgatggatgctgactgatcagagtggtggttgctgaagtttggaatggctatgacaattccttgaaatagacaacaatgaagtttgtcacattcattaactcttcctttcatgaaagatttctctgtaacatgtaatcttcttgggggattttacccatattagaacttccttcaaaattagtcaatcttcttaaactctgcaaccattttatcaactaagtttatgtaatattctaaatactttattgtcatttcaacaatgttcatagcatcttcaccaagaatagagtccatctcaagaaaacactcatgagattggaacaattcagtcacatcttcaagctctacttctgattgtaattctccagctatttccatcacatctactcttactgcctctacttgagaagtcttgaactcctcaaagtcacccatgagttggcatcaacttcttccaaatgcctcttaatattgatatttttacctactcctgtcaatattaatcatgagtattcttaatagtatcaacaatggagaatcatttccagaaggttttcaattgattttgcccaggtccatcagagtaatccccatctatggcagctgtccctgtattaaatatatttcttaaataatatgacatgaaactttgaaattcctttttcatccatgggctgcagaatggattttgtgttagcaggcatgaaaactacattaatctttttcatcttcatcagtagtcttgggtgtccaggaacattgtcagtaagcagtgattattggaaaggaatgtgttttgatgtgtgtttcagggtgtgtgtgtgtgtttctgagcagtaggtctcaacagtgggcttaaatattcagtaaaccttgctgtaaacagatatgctgccatctaggccttgttgttccatttctagagcacaggcagagtagattcaccataattgttaagggacctatccttgccctaggatttcagaatggtaaataaaaatggaattcaactgatagcagctgcattagcccctaacaagagttcgctgaagcttggaaggcagacattgacttccttcctttttttttttttttttttgagacagagtctcgttctgtcacccaggctggagtgcagaggtgtgatctacactaattgcagcctttgccactgaggttcaagcaattctcctgccacaacctcccaagtagctgggaatacaggcatgcaccgccatgcccggcttatttctgtatttttagtagagatggggtttcaccatgttggccaggatggccttgatctcctgaccttgtgatctgcctgcctcagcctcccaaagtgctgggattataggcatgagccactgtacctggcttgacttccttttacctatgaaagtcttagatgtcatcttcttctaatatgaggctatttaatggatacatcaaaaatctgttttttaatgaagccgtattcatcattaatcctagccctagttatagcttctaaagctcctgcaacagcacttgtttcttcatcttgtaattttatatatggtgacagtatcttttcttgagtctcataaagcaacatttgctatcttcaaacttttttttctgtaccttcctcacctctcagcctttatagaattgaagagagttagtatcttgccctggattaagatttggcttaagggaatgctgtggatggattgatctatccaggccactaaaactttctccttatcagtaagaagattgttttgcttcaaaatgcatgtgttcactggtgtagcactgttaacttccttcaaacacttttcctttgcattcacaacttggctaactggcagaagaggctaagcttttggcttatcttggctttcaatatgacttcttcactaggctttttcttttctagcttgtgattttaagtgagagacttgcaattctttcttttatttgaacacttagaggccattgtagggttattctttgttctaatttcaatattattgtgtcttagggaatatggaagcccaaggagagggagagagatggggaacagctagtcagttgagctgtcagaacacatacaacatttattcattaagttccttgccttatgtggcgtggtttgtgaagctccaaaagaattacaatagtagcatcaatgatgactgatgacagatcaccataccacgtataataataatgaaaaagttgaaatactgtgggaattaccaaaatgtgatgcagagacacaaagtgaccacaagctattataaaaacagcatatagatctgctggatgcatggttgacataaaccttcaatttgtaaaaaatctgtgaagcaaaatcgagcaaaatgtaataaaatgagatatgtctgtacttggatattgggttttaaaatccacttaaccactttatctctgtggttttggaagtttattccacttaacatttaaataattgctgatagggaaacacttactgctgtcattttgttgttttctgtatgtcttatagttacagtgcccctcttttcctctttagctactttcatttgtttccttgttttttgtagttccatgctttgatccttttatcaatttcttttgtgtaccccttataggtatttctgtgactctaataggtattgcatagaacatactataacaatctattttaaatggataataacttaatcacagtacacagatcttacttctttacatcccctccccaccttctataccatatattggtttcaagttagtgtctctgttggggaatgaaatatagagatttctatcccacaatcttgctgttattaattcccttttacctatttttaatggacaaatatacttgttaaattattattttctattaaaaataagtcacctaggcaagaaataatcatgttaatatactttattaaatactattaaccgtttttaagtaagtgaatttaaactgataactccatgtcaatcacatacactgccttataaatacaacttgttatattttatatcccttaaaccacttgtataggtgtagttgtgatacaaattccacatctgtgaatttagcctgccgcaaatcaaaattgttaattaaaatattacacaacaataaaaataatacaaataaacagtacagtataacaactacatacatatttacattgtatttggtattatatgcaatctggagatgatttaaaatatactgaaggatgtgcataggctatatgcaaatactacaccattttatgtaagggactacagcagatgtgaattttggtatgtgaagggtgtcctggaatcaatctcccatggaggaatgactgtatagttatttttcacagttttatcatttaaattctgtaccacaataaaaattactatgaatacaccttcattattctgtatttgtctacatctacctttaccagaggacattattttttatatgcatttctctttctatctagtgttcttttacttcaatttgaagaattgtctttagcaattttgtaaaacagttctagtggtgatgaagtcccatggtttttgtttatttaagaagatctgtatttctccctcaaatttattgaacaggtttgctgggtatggtattctagattggctgattttatttttctttcagcactttgaatatatcatcccactcctttctccctataatgtttctgctgagaaatgtgttgatctatgagatcttccctttacctgcaaaattgcatttttttcttgcagctttcaagattatctgtttatctgtgacttttgacagtttgataataatgagtttcagtgtgagcctttctaggttcatcctagttggagatcttcaagtttcttctattgtatgttcattttcttccccagatttgggacatttttgaaaattatttctttgaataagctctctgcccatctccttcttttttcggacttctataaagtgtctattggtctgcttgatggtgtcatataaatctcttagcatttcttcacttttcctaattctaatttccttttagtcctcaaatgtcatgcctttgaattcactttttcttctgcttgataaaatctgctattgattatctctagtgaatatttcacttcattattgtattcttcatcttcagaatttctgtgtgggtttcttgtcttttctatatttttgacattttcagttcatgcataatttttctaattttatttagctatctgtgtttttgttttagcacactgagcttctttgagatgattattttgtgtttttaaagataatttacagacctggtttccacttggttttcggtggtttattttgtttctctgttgcttcatatgtctgtgctattattttttttctgggatttgtgaatttgaaaaaatcagccatgtctcttagactttttctaactgattacacaccggaaaagaacttcaccaatcagcctgggtaaagtgtctcccaaacattttcaggggattcatcttctctgggcatgtaatatcccaaaagagaggtttgttggtttctttttcctgaccttataattactatttcctctgctggtctggctgcagaactgcaggttctctagtgctgcaatgagcccctgaactcttctgtgttctctgagcctcaggcatccagagtatgctatgtctatcagtgcacccagtcagtgacacagaaaccagacccttgtgcactcccccaaaagccagaatattggatgagtgttttttgcttttcttccactctagagagtggctgcaagtttgacacttacttctgatcacaccaagttattccagcttagtggaagggctgtcatgggtgaaatgaaatggtctttttacccatttttaatgtggctgctcttggctttgagcttacctgggttactgtgacttattaactagtttctggagcactcttcaaagctttcttaactatatattgttgcaaagttggtgtgtctatgggaagcaaggtctgaggtttctattccaccatctttctgaacttcatcaaagtcagcatatatatgtgtgtgtgtgtgtgtgtatacacaaacacatatatacacgcatatatatatatatatttttttgagatggagtctccccctgttgccaggctcattgcaacctctgcctcctgagttcaagcagttctcctgctcagccacccaagtagctgggactacaggcgcttgccaccacaccaggctaatttttgtatttttagtggagactgggtttcaccatgttggccaggatggtctcgatctcctgtccttgtgatcatcccgcctcatccaccaaaagtgctaggattacaggcatgaggcaccgcgcccggcccgaagtcagcatgttattaaacaactcccactgtgttccccagaaaggtatgcaagcactggttgccctacattctttccaatatttgatgctcaaatatttcttccagccattctattgagtgtgcagtgaaatcttattgtagttttaatttgcattttcctgatgactaataataattatctccatattgtgtgattattggccatgtgcatatcttcttttggaaagcttctgttcaagacttttccccatttttctgttggtatgttctttttactattatagtgcatgaatttttaaaaatattatctatataagccttttgccagtgatataaattacgaagattttctcttagtctttgtatatctacatttttcacttgaggttgtctttgttagcagaagctttatttccttttattgtttttgtatcctctctaagacatacttgcctaccccaaggttgcaaagatattttttcttattttcctctagaggcctgttgctttagcttttatgtttacatttataatacatcttatatttttgtgcatcttacataagaatcaattatgtgtgtgtgtatttgatatatgtatatatatgattattatttgatcatacatgtttggatttattttgagatactttgttatttccactaatttacatgtctatttttttaaatgaaaatcatattatttattattgtaacatatcctaaagtgacctagaagaggttcttcaactttgaaatctgtaaagatcatttggctattctacatctattgtattgctgcatatatttcagaaatcgcatgccaatttgcataaaaaatgtattggaattttgaatggaactaaattaaatttataaacaatttggagattaccttttcatttatgttttcttctcagcaatatattagtctttttaatttggaattattgcatatctttcattaaatttatttatatgcattttatgttttaattttattgtaaataatattttaaaacttcattgtccagttgtttattgccaacacataaaatataatttaattttatatattaacatattgcaacatagcataattctagaaagacttttctgcattcttaacgtttttctatatacacgattgtgttatctgcaaataaggttttgcttcttcctttccaatctacatttctttaattattttgactttcccgttgcagtggctaagacttccatttttatttttaacaacgtgttaagggtagacatccctttctttctcttgatactagtggggaataatctaggtttattttgtcattagttagggtatcggatataggtttttaaagatgttctttatcagatagaggagcacatctattcctagaacgctaaagtttttaatttgctttttgtaaaaaacaaaaattgatggtgaattttctcaaatatttttctacatacatcaaaatattacatatatgctttcgttctttagccttttgatatggtaaatgtttaaaatggattttgaatgtaaaaccaagcttgcatttctagaataaataccacttacttggtcatgatgtgatatatttttcatatattactaggcttggtttgctaatatattgtttacatttttcttttttgcatatgtccataagagttgatagtctctttcttcttttgtaaattttggttagattttttttaatgtatttgttcacttcaactaagttgtcaatttctttcatgaagttatttatcatgaccgctcatcattccttttaacatccgttagctctcagtaatgacccctccttcattcctgatgttgataacttgtattttctgtctcttttttctaaattttttttttgctatgggtttatctaatttattagtttccccaaatatctgatatttgccttaattaattttctttattattttctcttttctatttaatttttcccagttttatttttatttttcatttattttgtttgttttgctttggttcaatttgctcctccattcttaagttcttaagatcattaagtttatacctaccttcttttggtgtatgtatttaaacatttaaatttcactcaaatgactacttaagattcagtcacagagtttgatatgttgtatttttatttttgttcagttcaaaatgtatatgctttaaaataataagtatatacatttgctttaaagtaatacatatatacattaaaatgtagaagatataaatgcaaataaacttcacaggaaaaataactaaaacatagtgtgatattcttacagtttaaagattagaaaaattatatccagatcagtatagcgagaaagcctatatttcccatcttagttccaggaaaattacagaatgtgagagtaataaaagagaagaacaatatctgttttttagcacatggactattatgtaagtagtgttccctatgacctatgatgtttgaaatcaagtataatatttcaaatattaattgagcgtcaattatatttgtgggtaatatttataaacattagtaactttaaaaaatatctttagaaaaatcaaataatcagaagtcaggaactattgtgactctaacacttactaaactgggaaatcttagaaaatgacaaatctttaaggcattactcatctttaaaaaatagatattagtaggcatctcattaaaatctaatatgaagttttttcattgcaattatacaaaatgtgataattttaatggatacttggatactaacaaagagtacctacaaaaacagaacatgcaaacatttttgcatcatggaaaattatagtttctaagggtaggatttaccacttggttgaaatatgacattaaatagaactctgtagacaaccaaaatcttgtattattttaagtatggtttctaagagcaggccactttagataattaaacaaaataatactttttataaggctgtacattttcctttataaagtcttaatgtttctgaaatcaaagacaaatttttgtgagtctcttttagtgcccagatacctgtagtcacttggcttacttgcaaaactctggctttagtataactgagataaaattgtattgtaatatctgatttacttgatattactgagtatccttgaaagtgtaatggaatgcatcagtttagaaggttatggcattctcaccagtggaatgttatgattttgtctcctgcaggtgctccaagtgaccagagcagtggcacctcctctcctctctgtgacagtggcttacatctcaactaccatcccaacaatacagtaagatgacccaggcatagctcagattaataaggagataacacatagcttataaaaactgctagtgaatctgatttatctgacagataggaaatccctggttgcataatcatttaagaattatgataaacaagaaatgcaaaataaatagatcaggtttcttatgccatttttttcccctctcaagtctgtatggattaagttcttttgaagcaatagatactattaacttggggatgtcactggagatgtataatatacaatcattttagaacattgcacattatatgtgatttcaggttcaaaatgctttgacattagttttctcacttttttcttttgaaattacttaactaaaagtaactatttaatttgctatttgttaggatttttttagccaactttattcacagtaagcaattactgcaaagtgagaaaatccaattcacacattattttgacatgtaaagaacgtttaactatacatgtatttagtagaagttaaaattaaactttgttttatagatatttaatacaattttaatctttgttctctacttgcattttgagtaaatcgattttaatatcttataaatgtttttgaagttccttgcatttcatccttcaaaacactcacacattcttaaagaaataattttctctggttataagcagatctaacaatcatctttcatgcttacaaacataaagagaagcagaggtgacgttaagcagaattttattgttctattccacatatcatggtacatacgtcatatagcttcttcaaccgactggtatgattcatcctgcaatttgaaatttttgtcaaaatagtggcattttacttcaaagcaatctttttgaacatcttcagtcctgaatggctttcacggtacctgatttccctagtattactcctcagctgagtaccttaggccctcaagttgtcaacttttttccttcgtaaaaagaaatttgccaacaccaaaggttatctgtacaaatctagggatattttctaaaaccatcttcagctggatatatttcatgtggccatctttgaaactttttttttttttgccaaagaaataattgccacacaataagtggcatttaaaaccacaatacagcatgattggagtgacttaaagtttatgaggaaatatacaggtttcctaatgaaaaacttagatatacaaccaaattttttacctctttattttgtaattgctttgctcaccttcttccctcccgatccagatgccttcgataatttcgatccacttctgttttccttcaccgcgctggtgcacctgccctcagtagctggaggtgttggctgtgcccattcacagcttatccctcttgtctggatcccctttgcctgggagtcagagctcacaggggtgtttggcaccacatgccctgcttccatcagtcctcagaggttgttcctgagagtgccccctccacgtgtccctcacacaagaatctccatctcacctctgctcctaagacagaaacaagagcaacttacttcagaatgggagaaagctctttggagctgttttgttctaggtcttgcctcatacccttgaactcctgtataataagcagagcagaggagtcagagtggcaggtctaagggtagaaatcattctggtttgtttttaatccattccattgacatatagaaaaacatatatagaataatgtccttccttataaaactgtaattacagcaagaaaatcactccaattctataacatcccaaataaattcagttttataaaattaaaaataaagcaactgttataaattcttcttactggagctatgtctccccatttccagaggcacattttattttccttttagcactaggattgaacattcttttgacattgctgaagatatttcagtgtaaggaaattgaaagtatcatgatgctatagagaataataataaaaccgtatgaaaacaaaataaagtatattcaaaataaagacaaaaatctcaatgcatatcaattaaatgcatttttgttgagaacttactctgtggaaatacccctctagctattttactttggggagctgttaattatgattttaacacaaaaaaattaagatccagatctatagacaaaagcatacaattaactataacataagcagaaaaagagaagaatgagtagcagcattctagtaacagagataaagagttgtagagactttgaccatctgactaaaaattcaacgtaagttgagagactacaaaccaagtgtgtgctttgttgctcgcacgggagcattaacctgcaatggtaatcagaccgtgcaggcttgcacagccagggctagcacgtgctgttccttctgtatcttgaataagctttgatggaggaatggcaagtggagaacatctctactcagagatgtacaaaattaggagaggtcaaagacatgaaataacaacagacagtgggcactcagaagaaagagtgcattgtgaggcaaattttctttccacagaatatgtgtatattatagacagtctatttaaaagaaacatttgattttctgatgtgtgttaattctcagttctatcctaggctcacaaactgccttttcaatgtctataccttgatctgaagccaattttgagtaggtattattctggttttctaacatgtccttactgtattttaaggcagcattttaattctaaggggaaataaaggcttatagtatattagcatcattccactatcctacataaaaatataatctattccttctaaagatgcgcgacatcactaatttgaaggtacatgaaagtcacttgttttgccaaccaagaccttggctcttaagccccagcccagattcactgaatttcttctctctagagatggagtagaagaatttgttctgtgcttaccagaagactctgattcagataatcagccaaccagactgagaaacattcttcttaactgtacacctttaattaatacatcctatgccaccaaatccttaataaaatctcagttagcagtttgccctttgtgcagttctgttctggtaagatagttgttcttgaggatattgtgtggcatgtgtaaaattttgggaaacaagcaaggagacataattgctgctttttccagtcacattattaatattgtaggaaacaacattcttgacattgtagagtagagctattgaaaaatagtcatggttctcaaaagcacaaaagtgattgtgtttttagactatcttttatgcaaaaataaataaactactattccaaaaaaatgattagaaagtaaatttatattctatttacataaataaaataagtaaggagaaaaattctttaaaggatagcttgtgttccactgtaaataacaggtctataatatgaaatacatcaactctgttgagtcaaataactgaagtgggacttattacatatttcttataaagaagaaatataagaaagtgacatacttatacctttggtacatacaggcatcaaatcaagatgccacaagaaagaatgtcaaaggccacatatatttccatacttgccaatctatgaagtgtattgataagatttgtaaaacctaccgtactcatgtattggtgattagtcagtcctcaacatctcattacccatatctttaacaatctttgacattttctatcccatttattgaagaaacacaaaatttgaaagaaattattattgtattttatgaaagatgagaaagcatctttaaataatatacctgaagttatataaccaaaatgtgaaataatcaagtaaaaaaatccaaattatttttccattgtttcactcctgattatccaggttgaatgttaaatgttccacagtagatctgttggctctgctatcaaaaaggtgttagtctgagtgaatcctgggggtgccctttgctggctgggtgacttgggtaaattgtttactatagaacttaggaatgcgtgtgtgtgcactggggttctgggaaggagtttcagtcattgccaacgaggaccttgctttgtgcagctgggtgggtcctgggccacttgcaatccctgtggacatctctggcctggtcacagaaaccttgtttgtttacccaagcctgccacacagtattattgcttcttcatgttccctcatgaagaaaagttgggaagtaataataaaatacttctttaaaaaaactttcttgtctcacgcctgcaatcccagcactttgggaggccaaggcaggtggatcacctgaggtcaagagttcaagaccagcctggccaacatggtgaaaccccttctctactaaaaatacaaaaattagtcaggcctggtggtgggcacctgtagtctcagctacttgggaggctgaggcaggaggaccacttgaccccaggggcggaggtttcagtgagctaagatcacaccatgcacttctaagtgatagagtgagaccctgtctcaaaaactaaaaataaaaaaaccttctgtttttcctttcaaatatgaacatagtaatagctttgtttttcaaagatgttgcaagtggtgtaagtcaagcacttagtacaagtaggtattattaaaactactattaaatagtaacagtaatattcctaagaatgccctccctaaaagttccatgtttagaaataattttgccccttatttcagcttattattatttctcgagaatataatatttgatacattttacttacagctaccaagccaggcatctaagtagtttgttttactaaatgttaaattaccattagccttttagatatattgaaaatagtatggagccatttagctgggctagattataagaaattttttatttgttgctataatcttaccagttgttaccattattatccccactttgaagataaacatagtaagatagagactacaaaacttgcccccaggtaatggactactcagttgggaaactggtattcaaatctaagtgttctgattctgacttgcagcttaagacctcgccaccttgtactatctcccagctgatcccatgtcatatgctgaccacctgtacagctgacatgaagatctgacctcacatcacatgccgatcatccataacatctgacatgaggccaggagaaagagtaatatgaaacctaggtttgtgcctttgcagtcaccagagaggcattaaaagcaactgactagcattgaaggacaggtgacttggaagctgaggtgctcattgagtcaccagtagggacccctcactaagtgatcttagccagtccacacttccaggtattctaaactgctccactgacttagtacatttttatttgctcaatctgccacaattaacataaaatgccaggcaacatacaaccttaagtaaaagtaatattgtttttcactggaagcattgttaaaaagtttaatgcctgagagtaatgcttaataatatttagacttcacagagtttcaatatctagactaaaatagaatcttcttccaacactatcactcaaaaattagtgaataaagggaagtcaatgttaccagtttactggtcaaattgagcttacaacccatgccaatttaaatattaatattatttgatgtgttggtgtgatgaagaaattttaacattaaaactgaaataatgaaggaaacatgaatcaagtgaaaaagcccaaattttatcaaatattagtctcctctatatataaaggaagaaaaaagctctaacaaaacttaatgtatgtgtaattttaagccagcagtagttgccttgatatgcaattaaaacaacataagaaagtataaactttttatgaacatgaagttagaaaaaggagcacagatttccttgagcagtgttttgaaagttgttttataggaaagcttattctattcaaaaatatttgcaaaaatctgataaattaaaaacacttatgattgtgcttggcactcataaaatactctctatttgaatgaactacagctgatttttatttcttcacttaattggttaattatagttacagttttttcccactttttccattcttgaataaattatgttctgtcacattcttatcctttccttccagctcccctcattttaaaatacgttttcactagcactcttagtctcaatgattcctttcttaacttcttatagcattctgttaataaataagttaaccaatacaactttagtgtccataatttggacttcttctcatggtattccattaaagtcttttgatcatttaggggaaaaataatatcccccagataaaaggggtttgagatacagaaactcaaagcacagaagaaaaaaattacgttgaatatttatcttcctttcaggacacattatcatgctcgtcgtggccgacgtctccaggcttgaggtgggagaagcgatggtgcgacctcagactgatccctctacttcattcgcgcttctctcagtatgtgcccggcacagatttgagtcggtgagtccgtgtttaggagttatgactgttttgtttatgaaaaaagagaccttttagaaaaccttttgacatatcacaatacgccttatgattttagtatgtttttgatagtagaaagaagagcttcaaaataataatctaacaaagttaaacacttattattctgatgacaaaaccacaagttaaagccctgactctgctattaacttattgtaatggattcaatagactcaatagatagttttattaagttttcatatttcatatttgttaattgtttacttctcaagaatattgcatagtttatctatttgtttgtttgttcacttattttgaggcaaggtctagctctgttgccctagctggagtgcagaggggtgatcttagctcactgcaacctccacctcctgagttcaggtgatcctcccacttcagcctcccgagtagctgggactgcaggcacatgccaccatgcccagctaattttttgttttgttttgttttgttttcgtagacatgggagatctgcctgcctcagcctcccaaagtgctgggattataggcataaaccacatgcccagcagcatagttggtctaaattataagatttattttctgcttttaatattcttatattattatctattttagtaagtgtaagataagtagtgccctccttttcattcttgaaactttttttctctttttatcttgatcagttttgctaaggagttgtacattttgttgattttttaaaaatgattaatttgggactttcttgaatctcttaacttgtatgtatactttatgagtctctgctttttccctgattgtttccatttcttaagtttttcagcttgaatttttgttcttatagctttctgagagatataacctccaggggttgggaaactttcctgtaaagagctgtatagtaaatattttatgctttgcaggccttaatgtctccatcacaaagtactcaactctgctcttctggcacaaaaatagccatatacaatatataaataaatgagcacacctttgttccaataaaactttttcacaaaaacaggtggcaggctagatttgtcccataggctgtagtttgccagtccattttgataattaattttaagatgtttatctcttaatatatgtagtcagatcttcacatttccagcaaatactgttttagttactcctgcaagtttagcattacctcttgatttatttatagtatttttgagtatatcactttgcatagttttctgactggttgcttgaggtattataatatgtgtaggtaatatatcacagtctactggtaacgttttaccactttgaatgaagaatagaaatgttgcttccattaagattcctttatctttcctgtttgtaaagatattaccttaacttcctatatatacatcaaacactatatcgggtggtattatgagttttgcttcaaccatcaaataagattttaaaaactcgtggaaaggataatccattatacttaacccaaagtatacccatcaatgatctttctgaatttcaaagcttcttttaccgcttcctttctgcttaatttttttagacattctttaaaggtagatttgctagcatctaattcccttagttttcatttatctgagaggatacagactttggagttgacagttcttttctttcagtacctaaaatatgttaggcattaatgtctactgtcattcaaatcagtgtcccctgtaagtaatatgttctttccctctgtctgctttcaagacttttttttcttttcttttcttttttagtttcagaagactaattatgacgtatgttggcacatatttctttaaatttctcctaaatgggctttattctgcttcttaagtctgtatgattatgactttcaccaaattaggaaagtttttgacctttattccttcaaacacttgattagtcccgctttccattctctccctctacatctctgttgatgcaaatattaacccttttattattgtcctgcatttcactgagaaactttttaaaaaatctgttttctttctgttaaacagattgggaaaagtttattgatctgtatttatgctttcaaattttatttcctgtcatttaactctgctcttcagccaattcagcattttattttttgtcgatttatttttttcagttctagtttatccttttaaaaataacttcttttttgaagtttttaaaaatatttttatttgtttcaagaaaacttgtaattgcctgttgaagcatttttaggatggttactgtaaaatccttgtgagatattttcaatatctcattcatttcattgttagtatcattaattcttttctcattcaacttgtgattttcctggatattgatatgacaagtgatttaacaaaatcatcctagactttttggatattaaatgttgagattcagattactatttaatctgggttttgttgttgttgttgttgttcttgttcttgttgtttttagcaggcaatctctttgttgtgaggactgggtgggtgtatatgttaagtttcctactgcaccatgctgacacctggaaaggtagatggagagggctattcatatttcttggttactaaaggttggaggtagaagctcagctcctcagggaattctactgacataaggaaggaggtggacggataggtgagggcaactagctccacctcccaccacctcattccactgcggtgatgatggtgggagagactcagctccttgctgggccacacctgtcagcatggaaggggaggcacagtacttgtcccatctcccacaagcccatttattctaattgctgcaggtgagtatgaaggttcagctgtccatgacaccccactgacactaccctggcagggaaattggagcctgcttctttaaggtgtaggatggaagaacagcttcttgctaagccctgctgaaaaccttgtgaacagggagacaatggttccattggtatttgactggatttgggcaggtattgccaaaagtttttgttttgtttttattgtacccattctctagtccttcaaaaaggagttacagatttttattggaggctttacgtttttaaaagtcttgctgttagccattcagattggaggtttcagagggtcgtgtctaggacatgcaggaggaaaacccaggggattcagcactttttttatccctgaatttgaagtccctagccattcatgcttagctgttcacctcacaggggcttcccatacttttgtcatcttatgtgtgaagttctttagttgcatcagaaagcagctgataagaatgaggccactctgtcttggccagaataagaaatccacaagtattgatattcatgtattttaaaaaattcatttgataatgttttattttttgttataattacttctatgacctatggactatttaaaagtgtatcacaaaatttcaaaatattttgggattttctaattatctttttttgctatttctatttagtataatttcatgctagatgatttcaatactttgatatttgttgaggcttgattttactcagcatatacgttattttgggaaatgttttatatgtatttataaaggatgagtattgtcatttttttagtgctgtgttgtacgtatttcaattaggtcatatgtgttcgttagaggctctgatcctctgcatcattcatgatttttttctgtttattgtattaggttttacataaacatggtaaagtgtcccactatgatggtagatctgtgtgtttctctacattgttgagtcagtgtttgctgtatatatttaattatgttgtcagatgcaagtagatttagaatttttataaattcctgttatatgatgcttgataattatggcatgtccagtacctttggaaatgtttcttgcctttaagtctatctgtattaggataaataaaaaacagatttctatttgttaatatctacttgtatattcttctatcctattctttaaacttttattagtcttactgtataaaatatgccccttctgcattaaatatatatgtatatatacacatctatatattatacatatatttgcaatattctttgttgtttttaatccaaagtaacaaacttggtcattaattcaaattagtctagttacctttaatgtaactacatatatattttgattatacatcttatttttttctattgaaaatcctagctttttataattaaaccttttattttgaaaaaattgaatattcacgtgcacttgtgggaaatagtattttcatttactcttattatcccagattgtatcacattgcaaaactgtaatacaatatcccaaccagggaatggacttgacaaaattcaccactaagattttacctgtgtgtgtgtgtgtgtgtgtgtgtgtgtgtgtgcatgtttatttctgtgaaattttatcacatatgcatgttcctgcatccactaacgcagtcaagttttgtatgaacagttccatcattgcaggcattctcctgtagtccttccataactacaccagcatccctcttgccctcctccctcaccacatttctaatctctgacaactaataatctgttcttcacctctgttatttgatcatattaagaacattatatatgatactatataaccttatttaattcaatttttgatgcataatagatgcatagttttagaatacatgtgatcatttaatacatccatagaatttgtaaaaatcaagttagtatacttacaatatccatcatcttagtatttgtcttttctttatgtgagaactattcaaatccttcttttccagctattttttaaaaatatacaatagattattataaactacagtcaccttactaagctatttaatactaggtcctatgtcttatactatactatatatttgtgttcatcaatcaacttctcttcattctctctctcttctaactttcctggtctcgggtaatgaacaatttactagctgtctcaatgagatcaacttttttagctcccacttaaatatgagtgagaacatggaatacttgtctttttgtgcctggattatttcactcaatataatgacctcaaattccatccatgttgctgcaaatgacagaatttcattttgtttttcatggatgaataatattttattgcatatgtatatatacatatatatatgaatgtagtatatgtatatatacatatatatgaatgtagtatatgtatatatacatatatatatatgaatgtagtatatgtatactacactttctttctgttttttttttttttgagacggagtttcactcttgttccccaagctggagtgcaatggtgtgttcatggctcactgcaacctccacccccgggttcaagcaattcttctgcttcagtctcccgagtagctgggattacaggcgcaccccaccatgccctgctaattttttgtatctttagtagagatggggtttcatcatgttggctagcctggtctggaactcctgacctcaagtgatccacccgcctcggcctcctaaagtgttaggattaaaggcatgagccaccgcacctggccaaatgtatactacactttctttagccatttatgcactgatagacacttaggttgatttcacattttggctattatgaatattgttgcaataaacataggagcacagatgtcttttcaatatattgatttcctttctttaaaatgtatacccactaatgaaattgctggatcgtgtggtagtcttattttcagttttttgagaaccctccaaactgttctgaagtagtggttgtactaatttacattttcaccaacagtgcataaggattcctctttctccacatcctcaacagcatttgttattgcctgtctttcatatataagccattttaactggggtgagatatctcattgtagttttgatttgcatttctgtgatgattagtgatattgagcaatttttcatatacctgttgaccatacgtatgtcttcttttgagaaatgtctgttcaaatcttctgcccatttttaagtcagattttttattgttattgagttgtttgagtgtcctgtatattctgttcagtaattctttgtcagatgggtcatttgaaaatattttttcccattctgtagattgtctctcactttattttttctcttgtggtgcagaagctttttagtttgatgtaataacatttgtctatttttgctttggctgtgcttttgacgtcttacagaaaacatcttagcccagactaatgtcccagagcatttccccagtgtcttcttccagcagtttcatagtttcaggctttcgatttaagtgtttaatccattttgattttatttttgtgtatggtgagggatagggctctagtttcattcttctgcatatggatcttcagttttcccagcaacatttattgaagagactgccctttctccaaagttgccacctttgttgaatgtgagttggctgttaatgagagaattgatttctgggttctctattctgctccattggtctatgtgtctgttttgttgttgttgttgttgttgttgctgttgtttcctcccacaggataatttcctggagattcttccaagtagttttattttttcagttgttcattccttttcatttctgagtgatatcctatggtatagatgtagcacatttaaaaaattcaacctttgaaaacatctaggttgcttccggtttttgattattctaagtaaagatgtatgaatatttgtatatagattttttggaagcatacatttccatttatttggataaatgctaaaaagtgcaatgaatggattatattttaatagtattttagtcttttaagaagcaaccaaattgctctctagagtgattgtccaattttacacttgcaccaacaatgtaggaatgactgtttctccacatctctgccagcatttagttttgttgctttattgaaccactttaatgggtatgtagtgacatgtccctgtggccttgatttgcatattataatgacattgagcctctttttatgtacttatttgccatcagtgtatcttcttcggtgaagtgtctgtttatgtcttttgcccattttgaaattgatttgttagattttatactgttgagatatacatatatctcaaattcctttttctcaacacacgagtttttgtgctgttttatttccttacctcttgtaataattaaaaatgtttattatttaatattctctctattcaattttcatatattcgtgtttttgttatcatttaagttatcgcctaagcattatcatagagccatacatgtataactattacagtttaacacaatttatatcaatttcagaaaatgttagaactttaagaccccttaattcctttgttttttcttatctttgggcatatttttgatatacttaaaatcgtatgttagatatttcaaaatttattattgctttcatataactattcaaacatattctatttttaatctttcttctcatttctttcttttggttctattttccttctaccttaagagctctgttaatatttctattaagagaatgtatattttttaaaagcgtacatttatttactttttgatttaaaaaaatgcagttacattatttgaagacatttagctagagaaatttctgacaagaaaggaattgtctgaatgggtccagatgactccttacattttcatttttatggcattcagcacatcaacagcttcatcagctgaattaattacactcaatacacatgacagcaataagcatttacaaacatagcactattcagaatggatttcatagagattcacattcaagagctaatttattgtttactcattcactcaaccaatattgacttaatatctgtaagtgggagacattatgtttgattctttctctgtaaaagctcacagactagtagtagtagattcagtgagggagtggggggcaagaaaagataaataagtgatttataatagattcatggatgaataatacactattgcatatatatatgtatatatgaatgtaatatatgtatactacactttctttagccatttatccactgatggacagttaggttgatttcatattttgactattatgtatagtgctgcccatgattacaaataaagaaaattatttagcttggctcaaatgtaggatattatttcttggttgctttttttccatagcccataattttaacttcagtgatataatacctgtcatatataattgcaaccaagttgtgttacagtcatgtactattgtgcatatataaattaaaacatcatgatatttttatcagtaataatacagtttatatttatcataatgtaatgaccctgattcagatataaatatctgctttaaattttgaagtatgttataatattgcagtgtcaagggcattagaataagagataaagattgttaaaattggctggtcttttaatctcttcaagctttatttttcttatatgcaaaatgagcatataaatatatgcacctgtcactttatataatattatatacatgttatataaatatatatatatatatttgaatttgagaagtataattttgaggagtactctcagtgtttagcatactttatggctgaaagtactcaataaatatttataaaatgaattttaataaaaaaattcatgtcttagttttttctttaggtagaattatcatctactgcatgctttttaaacactatgaaaatcgataatattgaaagtaggcttttggactttaaaaattctcaaatgacagtagaatttctagttttctcccagagtgcacacacttgtttaccttgagatgaagacgtttcagatggtgacaggtttggcactggtggatgaaatttagtatctaaacagtaggcaagtttagtggttatgagaattgtgcttttaacaacacaacaatcttagcaaatgggtctctaacaataaagcgaaatatgaatctgacttatagtaaatacttaattcatggttgttcattgaaggagggaaacctacaggaatgtatattttgggggatctgaggaggaagcacaatcagcgaatgtgtgaagcagaaaaaagtaggtaggaagaaaaagaaaaaatactatcacgtaaggatgtcatagaagttatttcaatcagggttttaaggagaagaaagagtagattgtatcaactacagaaaataaatactgaaagaactgaggagcagtgattaatttggggatgactttggatagaataattgtagaagcaaattgataaaaaaaagtttgtaagaagaaacatattgacagtagagaaaggagcacaatatgtaagagtatattcataaaatgtgatgagggggaaaggggaatataaaatttaagcatatcatgatgttggttactaattgagaaggaagacttttttattattattattatactttaagttttagggtacacgtgcacaacgtgcaggtttgttacacatgtatacatgtgccgtgttggtgtgctgcacccatcaactcgtcatttagcattaggtatatctcctaatgctctccctcccccctccccctaccccacgacagtccccagtgtgtgatgttccctttcctgtgtaaatgtgttctcattgttcagttcccatgtatgagtgagaacatgcggtgtttggatttttgtccttgtggtagtttgctgagaatgatggtttccatcttcatccatgtccctacaaaggacatgaactcatcattttttatggctgcatagtattccatgatgtatatgtgctacattttcttaatccagtctatcattgttggacatttgggttggttccaaatctcactctgccacccaggctggagtgcagtggtgcaatctcggctcactgcaacctctgcctcctgagttcaaacaattttcctgtctcagcctccagagtagctgagattacaggtgcccacaaccatgcctggctaatttttgtgttttttagtagagatggggttttgccatgttggccaggctggtctcgaactcatgatctcaagtgatccacctgcttaggtatcccaaagttctgggattacaggcatgagccaccatgcccggcagagaaggaagactcaatggcaaaagtgctcataaacagaaacagcacccacgtctgatgcggcagctgcccctgcagtttcatcatcctgatgttacatgtggttctcaaaagtggatacagaggttgaattgattgcattccacttcacagattggtcaggaggtccacaaggactggtctctgtgtaactcaggagcaataaataatttttagaaaacatcaactaaataccattaagaccctctccataaggcatgcaagtattccttcgtctggcataaacctcttcacttgttcttacacaattatgtaggggattaaaaaagaaactgccacaatccccttaaaatatatgaatctctttggaaaagtccactcttcctttgaacaattctagatgaattttgtatagttctttcaatctagggcaaattatcttgccaaagagtcgctctttgtttcatttctccagtttattataacacacttatttaatgatatgaatttattaattaatattaattttaattttgccatagccagaggaggacagtattccagggtgcttgaatatctctggaaaactgaacaataaaaataaaaagaaataacccttgaagaagtatatgtattctggtaggcttcagtcacagaataaaaaattacatttgatcaaatgatcgaatatatattttcaaagaccataaattttaaccaaatataggttaaaggtgtataatgtagtgcttctactgatgtcatgagatattcaaaatttgcatgacaatgctttctgcttcaaatgccttcgagatggcaggattcaggaataaaaggacagagaaattatggaagagctgttatgtgactaggattagccaggaagagataaataaaatgatgtccaggtaagcatctgcatatgtaatacctgctcctgtgagggtagaaaggtaacaaagtagacaagagcaactaaggaccttggggtcccagagatcaattgtactggtgcttctttgcacaatttattacttttgccagggaatcctgctatgccaggaagaaaagggtattcatttagttaaactggatttattgagggctgggaagtagtaagattggagtgactggaggtcacagtgacaggaaattctaaaatgaaaaataaccacgtaatttgtgtggatgaacaggaagctcagtctaggcaatgcagctagatcctggatagatatatgaactagggtaattggaagggctaagaaagatcagaaaaataataaggtaatttggtggtgatggaaaggaagagggtgtagttaaagaacagaaatgtgagaattcaagtctgacagtggagctgtcttggataacatcagatctcaagttagcaaaagcaggagattgctaaagtaaagtggagatggacttgtttgtttttgtttcttacttacagattaaagattccgagcactgtgctaatgctatgagaggtataaaatagcatatatggcttttccttcaaggagctagcagcttggtaagatcgaacagtatttagcgctacacaaacatgtttaataccacagagaacaagtgttgcaataaaggaatcaggaagtcgaggggcactaaagtggaagagattcattccaaatacatgggttaaagaaaatctcatggaatagatggcacctgagttaacttcttaacatttgaaatggattttgacaggtagaaataatacaactggtatttttaacggattcttcagttgttaagaagtccagtcgatagtcttcaaaatacagcctgaggtgtgcagaatatgtgttgccttcttcatttcacgaccagaggaactgcgggtcagagagtttcacggtgttaactgacttgcaaggacctcagagatattgaaggagcatagatgggcatctcagacaaaggagtactggggagaaagacgctgttgcaaaaagtgcaggacttctttagggaatgacaagttatgtggtttcaattcatgaaacaactggtgaatttaagatctggaaaataagtcacaaaaaataacttgaaaaagctcctgatgtatctaaacagcttaggttttgtgcctgaaaaattaaaagagatgacatggcagtgaaccaaggtagtgcacacagggaagaaacagctcaggcctgctatgtgtggattacactcaacaagacagagtaaaatgcaacagtcacaaacccaaggggcctcttcttatttctttctttccttcaataacatccccctaccaattaagtgataatgaaatcaagtaaatgagtcaatgttctgtcctcacacacagggccactctgtgagactgatttttctcattgttcattttgtgtactttattctctcttttttccatatccttcaccccacagagagatatttctaaaatataaacatgatccttttcctccaatgcttcaatgtctccactggctcccctgactctcaggatcagagagaaaaattgcagcaagatatgtgagttatcactgattacaccttgtccgatcaccaacttcatggattgcctcttcttcagatccacacacaatgtgccagacaacccacatttctttggatatactatgtttttcatgccttggacatttgcttttggattaattatctcctctctaaaaattttgctttcccttacctgccccaaccaagccgttccactgtttagcccaatagggtggagtagctttgattctactcacttcttcttaattcattttaaaaagcagttattgaatcacatcgtttctaatgactttaagggggaaattatacatagaacttcagccatatgtgaaagtaccgggatccaccaattactcatcaaatccttattaaatctgtaaattgttctcatttttaggggaaattgaggcacaactaagtgaactaagttgcttcatcttcactctcactaatataagtttatttcagtttcatatcatctcaagttttaccagtgacagtcttttcctcactggtctaataggaccacccaagccacacaaatctagccactctggccctctatatggaggtgagcagtggttccttgcagactttaagcccacctcattctgagcctgcctgtttttccatggggagcttccagaactcatgctcattccagtcactccaaacttttacattttagtctctgcagctcttgctccttgtgcatgaaagtacatgccctcatgtggggtaaaatcaacaatgaatcaaaacaggaatcactaactatattaattagaaatgatatatatttatttgattgcttatgttaggttgaaaattattcatgaatttgtatagtgagcagtatatttttcattcaaggaagactaaatttgtattttaaatgaataaacctactttgagattgagcaacatttaaaaatactttttactgccagagcagttaccaagaatctttagaaagctgtataagtgcagagtggaaaaacaagcctgaacaaaaaacttcagactaactcttcagtgatgtaattttttttagtgtgtgtgtatatatatatatatgacacataattttgtctgagtatccataaggttaccgttaatgctgtaaaagtttaatgtctcacaatgctaaattaatgggtaatggagtctattgatttcataataaatattaactatttttgtttatcttgagttaaaaaattacattttctaaaagctacaaataaaaacaaaagcacttcagtttttccctagtgcttgatgagacaataattctatgtggggacattttcttttaacactgaaatattacaatcaagagcatattgatggattattcaagggaatattatacatagaacttcatccaggtattaaagtatttagatccaccaattattcagaaaatacttgttaaatctgtatggtaaattgttctcactttagatgaaattgaggcccaactaagtgagctaatttactaataaccttctttacttagtaatggaggccccagataactgtaatttttatgatcaacttatactataagaggtcatatgtaataaaaaaactgttcaagtatttcacttatgttcataaaagagtttccatatttgaaaagttgaaacagaatgtaaaaagtgatatgtattaacttataagcctagtttcataaaagatcagcccctcagaattattctatgtaggcactatgtaacatctataattacatagattgaagatttgatctaagtgtattgacttttattagctaaaaaatctagctgctatttaaagcagagaagacaaatatgatcaagatatgctttaatttatggtacatgaagcaatggttataaccagagagcagaaagaaatatgtattactaaactccaattatttctcattttctatggatggttaaacttctgtctgaatactttaaacatcatacttgccattatacatcagaattaaagctaaaaatatcatgtgaaattataacattcttttcattcaatgtgtatgctgtcacaaattcaaactaactttctttcaaaaagatggacaatagttatacttctgaaattcttttagtatattttcaaaagaaaacaaaagagcatatctaagcacatcccttttttcattataaaatgctgtgtccaagatatgagaaccagtttctctaaaaatattaataatttgaaccctcagagtcgtggatgcccaaggccttaccatgtgcccagttctgagacaggaaggcagagtggcgtagacctaccagtagacctgagccagacatgctctatggggttttctttgtttggggaataaactctgttttatatccaaaaatgtctagtagaagagccaggaaaggtgtttggagaaaacatataaatttacacattttacatagcattttgaatactgaattgcaaaagttttctgttactgtcaaaattgactggaattgaaatatagtttgtgtattgtgttgcacaatgaagtaattcttaagcctgagactttggctagtttccatccattttgggattttatctattcctgtccattaagtttatatctaaacattgcaatatctggaagtaaggaagtcattgaagctatatgaaacacttttaaattcaatagcacttttgtgaacaattttaaaaggcatcatttaattgtctatgacaacaaaaacaaaagtcaataaaatactgtcagaatgcttagactgatcatagcattttaagaaaaagtttaatgttaatgaaattggcaacatccatgcaaatggagagcatgatcatttacacctggaaagaaggtatgaacctcttgttccaaatcatctttgggaagatgaacagactgagaatgagggtggagaacaatggacaaagtgctgccactcatgttatcatctagtgactttttaatatcacgcttaatattttattgcctgtttttacgatctttctaagtcagaaaatgcattgacaaatgttaagaggagacaatggtagccaaaataataagtaaactacgcataatgttatagcaaactgggaaaagaatgcatctaaaatttcttagattctcttttatctacatgttgtatgttttagaagtcaaagtttctccatagttacctgaatctaaagatgcttcctacgaaattgaaattgtatgtcatttgggtctatcttcagtgtttcatttaaaacagagatgcttataaagtcaggtaaccaaatatgaatttggaggctgatatttatattgtatgaaagataagcttttcaacagatactattacgagctgcaaatagatcaatgacatgaggttttgatctgatttgttctgaacatctgcaggcagaatgcctttcaagtcattgctgtggatggggtctgcactgggattattcagtgcctctctgctgaagactgcgttgactggctacaagcaatagcaactaacatttcaaatctcacaaagcacaatgtaagtaatgattcaaggaatacctagccagggtttctcaggctttataaaatccttcagtatatatgtaacttcacatcaactgtttggtgttcttctcagaatgagacattcatgaaagctattctggaatacttattgtaagaaaactgagagttctggcccaatttatgagttcaataatacacatagatttccattaacaagcattataaacccctacattacttaagcaaatgaaaataactagttagcatataatccctaaatatatttaagtaaaagcattcgggaataatatagtactgggtttcaagacagcattattgatttacctttagtgatcttagaattgcagctaggaaggtttgaggagtagtaggctaggaggaaaggagttagcatagagactgaagggaacagtcagaagattgccattgtctcacattagatagagcctggtctgtattattagaaatggcttctctgcattttctctctttccactacaaccgttgcttccttccacattcctgtgtctctttattgtagctatcttctcattattttaactctttaataacctaaataattctttcccccgttattaataattctatgagaaatatagtctaacaaaatatacaaaaccacaaacctcaccttactgagtatcaatctaggtatcattaatgataattattttagaaaaagtacttgtcatcatccatgcctttgtgttaattctctcctcagtccgcaattgttccatgcgatgttgaggcatttcagaagtcctaagggagatcaggagtctaatatacaaatgatcaagcagaaatatataactctgtcaccagcacgtgaacacacaaaattgttcttatgtaaatgacccttcagatccaagtatccttgcacagagtagactttgctttgaaacctaagaaaggattgtggccactatacctttctaaaacgacaggaggaccactagccaataaaggcaactgtctagtttccagtctatggctatttcaaacaacgccatcataatagccatgcatatggtgatgggatcctctgggaatggggttgacagtcatgggatatgtgcatggtcaattttaccaggcaatgctaagtgttttccaattggctgtgcaatttacccctcactcttggtggatgatatgtttctttctataatcttcaaaactctgtgtcacgctgccttttgaatttttggttgatacatgtggaaatgtgcttccagtgtgaataaaaacagattttccttttttttttttttctggtggttccaggataggtgtaaatacaccaagccttacccaggctcatccctcaacaaggaggctaaacatgggtatgtctagtttgggcaagagtgagctctcactcccaacccacccttgctaatctggtgttgtcaccatattagagttgaggttgcacaagagggcataggtttcagaatgactgaaaaacaaagaaaaaaatagaaaagaaatgcaatgtttctctagggattgtttcctctccttcgactgacttatatggatgcttctagagttaaacacagaaaaatacctgagagtagggaatttgttacagaaatgattagagtttcttaaaaacaagatatgaacttatatttgtgagacaaatataattgtgttcttttgaaagaacagaatgttaaactttgaatccaaagttttttttccttatctagatccaaatttgcattgacctaaaatcctaggaatattgtcatgccatatttcttcaaacgtctattcagttagaatgctgtgcttcagctgacaagcatttgaaaagtcaatgctttagttaaaagcaacagcaacaacaaaacagtgaagatgcaaatgtctctaccctctgtaagcctaaggagggacaagccgcattttactgcttgtttttcatccttgtaataagtgctcaccgtcatatgattcccctatactactgttttaactgtttggagatccatatgtctgttgcatattaaaagttatgtatttcttctttcacctcctgtttctatattctaattacatgttcttttgttcttgcaatcagtttccattcaaaagtattaggttccaatgtattctgatatggaaagtactacataaatgttgaaaagttattaggcatagcaataaaaaatgtgaaagtcacattgatttcagagaaggcagaatgcattgatgaaacaattaatatggttaattagcataaagaaagaaattaggcagaaagagtagctaggaaagttttgcttaggttagttagatatcagttctacttctcttattttttaattctaaagatatactggaaataacaccttatggaaagatgtagacctttttctttatttgccaatattctgagagtataggcttgtataagtctgacttgaatagcttgttaataataggtgcagaaataaaaacattgtgataaatatttaaagaaattccactcaagagattatcaggcataaaataaaactgaaaaaaggattaaaatgcatataaaataataagtttgacagtttaaaaattatgctattgaaataagacatacatatgtatataaactttttaatgatgaatcacattttattgtaaagctagttggagaacagacaggggaaggataaaagcaaaaacaaaaaacgaaaaacaacctgtgttagaataattagatcaatgtgttgatcattttcttttctctttgctcactagtttctaaaagtaactttgtgagacagggattttcatacccagtttttaaaaattctatataattatagttgctataatttttcttccagaaataattgatcataatggctaaaaatacctaggcaaacactgacaatgtaaaattgtattttatcattattcagagtggctccaaaatatttacaatagttgttaatatttaatacttagtaaatgatgtctactagaatgagggtgaaggctttagggacttgtcttaagctgtattggcacagctttcaactcattttatttaaattctatgctttcacattggaaagcaaagcatggcagaggctatgctgttgtggggtgggtggggttcagctcatttcttaaccaactctcacataatgagcatttgctatattttaggtgagcattcactcccagtgaactattattttaggtaaagtggacttgagtagattctaaaaggtagaatttataaattgtaaaaaacagtaattgcttccaattaataatttaccaattttttattcattatttcaccagctatatgaacaagtattagtagaaagttatcaatttttatttccatgatcatttcttattaaataattgaagactttaaaatatgcaatgttgtaatagggtgaagtttttgggaaccttggaaataagtaaatatatttggcataatatataagggatatgaatcatcagactttgatgggtaggttagtaagatgcacctccgtgatgttcacttcctggcatttacacccttatgggatcaccttccatgtgcgttggctccatagtgagctctgaagcagacacttctcttacaagacttcagatgagatagcagatgacccttgagagcatttttagaaatccagtacattctaacccacactaatcacatgctgaggactcagcacatgtcagtcacatgctgagggctggctcaacacacaaagatgtcccaaccagaggcccatgccagctctcccctaccctgcaccccatctcacaccactcagacaggcacaggctgtacagacaagttatttacttcttattataaccttgggccctttctgccctggaaagtgggggtgggcaaggaggctgggcccagcatgcacccccacttctttaggggctgatccctcctacagtatcaggcgggtggtggcaggggtagaggttggagagtaggggagaaaaccaaaaaaaaaaaaaaaaacaggatgaagacccagctatgccacatgtggactcctgacatacagagattataggataataaatatttagttaaagtcacaaagttttggggtattctgttacacagcaatagggaactgtattagtttcctaaaattccaaaatttcctaaaacaatttcaaagcaaattacacaaacttggtgccttcaaacaacagaaattcattttctcacaattctgtggcccatttgtctgaaatcagatgccagcaggatacatccctctggactctgtaatgcagaagccttgtctcttccagcctctggtggctgccagcattccctggctcacagccacatcacactgacctccgcttctgtggttacattgcttctttctgtgtgtgtcacttatcagaacacttgtcattggtcccagggcccactcaggtattccagtctgacctcaagatctttaactgaagtagatctgcaaggaccctttatctggttccaggttttccatgtggatattttgggaggagcatttttggcctaccacaagaactatctggcaggtgaacaacatgattagatttagacagttctgtctgatttttgtgcaatgtctcctatagcagttcagtttcaaagcctttgctttgtcatttgggtgttccacacgtgcattgcttggggtgggcccagagcttcttgcagttcacacataaaatcgggatatcgcctccttcccttcactcctaagtgggagttccccactcttactggatcgcagcatcactctctttggtcttctctccagaaatccaaggctcttctcagagtttagtttcctgtactgatgcacatttcctcatgactggagaaaacagcatgagaaaaggagagaagagtggggatccctcatgccacaaaaactaatttttccagaacctttagatagagggtggattttctctctgagtttccagctggcccggctgccccaggctccatggcagcagctgcatggccaggggggccttggagtcagctcaggaaccaaaacaaaggaacagtaacagagatgtcttccacagctgttggctcgcagaggcctcttcccaggtctctgatcagcaagacatgctctctcagagtttttgtttgttgtccatgacttaatttgtcttgacctcaagtccatgctgggagataaaggaagcaagaaaaagaaaggaaaacaaaataaaaacaggtaaactcctgtttgccatattaatcattattcaatttttacttctttcaaaaaagttcttgctattatttattgtacaatgttctcagatagttagttgccttttgcattttatctagtgcattgaggtataaccggtgggaaagatggctgcagtgttttttttttccttcttggctctaactggaagcaatagatacttttaatagaaaacaaaatataagaaacaaaacaactacatgatatttgtagagtatcagaaaaaaataactgctattataccttggaaatattttttaaaagtcctgataaaataaatttattttcagacaaatagaaaaataaagaaaattcaacaaaataaagatttactaaaagaaatattcagggtacttttaaattttttgtattttttatttattcaacaaatatttattgaatacttgcctatgatgtgtcagatactgtgttctatttttttgtttgttttgttttcaacttttattttagaaacaggaagtacatgtgtaggtttgttacaaaggtgtattttgtgatgctgaggtttagagtataattgaaaccatcaaccaggtggtgagcaaagtaaggggtgctatttcaggcaaagaaaaatcatgccagatagaggcttggagatgtcagaaggagtaaatagtacaggagaaaatgaatacatagatgaatctagatgaacattgtttgtattaaaatgggaataatttcttgtagtgtttagataaataaacaaaattaaaatatattgcaaaagcaataacaaaaatatccaaaggaagcaaatgtaattagtattaaattttgttatgtcaaaatggattgtttgtttcctagagaaagccttaactaagtagccagaatgtgtatcttctaaattaacaaaggaataagtgaaaaaataatgctaatacctactaaaagaagttcataaaaaaataaaaaaagaaagcaaactagagcaggttgaacaaatagtaagcatacagtaagatgatgatttatatccaagtataagatacactttttacaagaggaattctaaagatattggaagattgaaagtcaaaatttagaaaaataccttgcacctgaaaaaataagaacttggaaaggattccctatttaataaatggttctgggagaactggctaaccatttctggaaattgaaactggaccacttccttaccctttatacaaaaattaactcaagatggattaaagacctaaacgtaaaacccaaactaaaaaaccctaaaagaaaatctaggcaatacctttcagtacatagccatggacaaagatttcatgacaaaaacgcaagaagcaattgcaacaaaagcaaaaattgacaaatgcaatctaattaaactaaagagtttctgcacagcaaaagaaattatcctcagagtgaacagacaacctacagaatgggagaaattttttgccatctatccatctgacaaaggcctaatatctggcgtctacaagtaacttaaacacatttacaagaacaaaaatacgttaaaaagtgggcaaaggacatgaacagacacttcacaaaataagacactcatgcagccaaaaaacatattaaaaaaaccctcaacatcactggtcattagagaaatgcaaatcaaaaccacagtgaggtaccatctcaggccagtcagaatggtgattattaaaaagtcaagaagcaacaaatgctggcaaggttgcacagaaaaaggaatgcatctatactgttgtgggaatataaattagttcaaccattgtggaagagagtgtggtgattccttaaacatctagaaacagaaataccatttgacccagcaatcccattactgggtatgaacccaaaggaatataaatcattctattataaagacacatgcacgtgtatgctcattgcagcactattcacgatagcaaggacattgaatcaacccaaatgtccataaatagtagattgaataaagaaaacttggtacatatacaccatggaatgctatacagtcatagaaaggaacaagatcatgtcctttgcagggacatggatggagctggaagctgttatcctctgcaaactaacacaggaacagaaaatcagacgccacgtcttcttacttataagcaggaactgaatgacaagaacacgtggacacatcgggggaacaacacacactgtggctggttgttgttggaggggagggagagcatcaagaagaacagctaatgggtgtggggctcaatacctgtatgaggggtttatctgggcagcaaaccaccatggcacatgtttatctgtgtaacaaacctgcacatcctacacatgttccccagaacttaaaataaaatttgataaaataaagaaggaaaacaaataaataaataaattgacataattagaatatttctctaagtgtttaataactaaatggatttgaagcttttagactgacattatgacattttaagtaatgcttccatgtaactgaatgatttggtttgttctgtgtccgcatccaaatctcatcacaaattgtaatccccatgtgtcagaggagggacctggtgtgaggtgattggatcatgggagtggtttcccccatgctgttctcatgatagtgagtgagttctcatgaaagctgatggttttaaaagtgtgtggcagttccccctttgctgtctctctcctgctgccttgtgaagaaggtgcttgcttctcctttgcttccaccatgattgtaagtttcctgaggcctccccagccatgaggaactatgagtcaattaaacctctttccttcataaattactgagtgtcaggtatttctttatagcagtgtgaaaacagactaaaacagttaatttacaaattaaataaatatgtattttaaaaaccagaaaaaaggaaaaaatacagtgcaaaccataaaagaaaggtttgtagctttgttaatactaggcaaagcaaacttcacagcaaatatattactaaatatagatatggtcacttcataataataaaaaagtttaatgcactaggaaacaaatgcaaacatcatgtcacatgggcttaaatatatctagatggaattgaaaatatagactgatgagaaagtaaaaatcatgaaatctcagaactagagacacaaaatggttaaggcctggctatgaggaaactgaaagtaaaataatagattacggaatcagaagaagaaaataaaattcatgctcagcctttattttaacctatagggctagtcattatcacattattccatcatacacaagcgacatttcccattgaactattcattcagtactaggtgtctagaatgtctccccagcctgagctggacattagaactcactttaattatctgtcttctataacctttcagctttcctcactgtcattccttagggtcaaaatagtcctgtgaagattctcgccatccaaaatccatcttatatatgtccttacccaaaaaagataactgttcatacattttaaagactcctaaaattttctgatttataagttacaatgtgtaactggaaagcaatttgaaaaatgttattttgtcaataattcaaaactgacattttatcttggtttcatcttataagatttaactctacccatctgtggtaggaagaataatgcccacgcaaagatgtctatgtcctaactcccagaacctgtgacaattccatgtcatatggcaatagagaattaaggttacagataccattaacattgctaatcagctggccttaaaatggggaaattagcctagattatccaagtgggtctaatgtgattctctacaagtgtaagaagtcaaagtgagagaacaagagacagcagtgaaagaggaactgaacccagtatttctggctctgaagatggagaagggaatgcaattcaaagaaagcagtagtccaatagcagtgaaaggctgcacttctactctagagcctccagaaagcagcacagccctgccaacacctcaatttctcccctgtttgattcatttaggacttatgacctacagaacagtatgataatatataaatgtgtgggtttttcttaaaccaccttagtttgtaggaatttgatatgacaacaatagaaactaatacaacatatctttatccagttgcatgttttcacttaatgtaaagttcacagtttaatttgaaaatcatgcctttaactcatgtcatatgtagctttttcagaataaccataaaatgtacttgcatatgttagaaaacaacctaacatttacgttattaattagtcccagtgcaaatcagcctatagtaataccactagagttcctaaatacttaatttataaccaactgacatcatcagagaaacaatgatcagaatcgttgcattcacgcagtctgagcaaggactgtctttggaactgggaagcagtgttggctctcagtgcctggataaacatggctagaagctttcaaatatcacaggaaaccaggagggagaagccacacaagacgagaataaggaactgctgtccctgaagagcagacaagactgttgaattgtcaggcagtcacaactgagaaagacggcaactgatccctgagagtgtctgtgaagatggggcctagtgctggctggctcagatcacacagcaactactgcctgtatccttgtatttccagtacttaacacagcccatatggagcaaataagaagtgaatgaatgagtcccttatcaatcaacagttgtttgaaggaaacattgctgagaatgtaaagaaaaatgaagacagaagagagaaaaacacatttagctacagtaagcactgcaataagagattcacatgtactactccttaaattcttacatgttccgtggggccactgtgctttagagtagggaaaagttgctgtggtcatgaggaaacagaggtgctgtccatggtagatgttccctgtgtttctgggtgtagttccttttgtccatcataaatctctgtctctcataatgaaatgtctgatagacaaattttttttaaataaattttgtttctataactcactgagtcactttctaagtggcaagtacagaaaaatacagtgtagcagagcaattggaaataagtggactttaaagcacatatctagttgcaaatcaagacaaatagttttgaacaggtaccatgtacaacaacttggagtctcctaagaatacattgacttgtggtttcctaaaaccttcttactggaaggtatcaggagattatctagccccatttcctgcccaattagaaatctctcctgaaaagattctttcagacagctctctcctggaaatctttcaatgacatagaaagccattgcttcacaatatagcaattaaattttttgacaacttaatattaggaaatacttttactgaataaaaatctctctcattacattcatccatttgtactagttctgatttgagaaagacacacaataatccaactttctttttcaaagacacacaataattcaactttctcttcctccagcatacaaatacaagtgtcacatgttgcagtccgttttttttttttaaaatagaaatatcactgactcctttctgtttctctctgacatgtcatccaagactttccttgtcctggtcgctgtctctggatgtagaagccctttagaataagtagagtgataatataattaactttgtattattgtaattgtcatgagctcaaatatttttgagattcattatagtttgatgtatatttactgattttgtacaataatatataaacatatatagaaaacaacaaccttacattttattataatgatcaatgaaggatcatattttcacattacctgatattgcacctcatggtggcaatagtaaataaaattcaaagtttgaatagttattttgcatttaaactcatgtatgggccagaaagcccaattcttgtgctggctgcacgaattactaaatactcaaagggatgaaagcccctccctcccatactcaagtatttacatgaaaatctagcttctcagttttttacttttcaaagactgagattttagtgttgttgccttctttcttagcttacaatgatatttaagatgtttaacagaagtgttaaatatcatagtctataagtttttttaaagattaataattcattaaacactaacagaaggctagtttttgccttatatctttgaaaataatgccatacaatgaggacttcaaatgcaatattgtggatgttacaatctccaataaaaatatgctattattaaaaatgtcctttctttcttaattttgtttattaatgtgtatagcaatcttcttccagcgttaagaagggaaagtggaaaatatacaactttggagtggacaaacctaacaaacgctactgcagctgggtggttaacgtcaactgtgatgtcaaattaataatatgtacccttgatatgatgtaacaaaaatggccctttgcctctgtgattttcgtccccaaatccataatcctagtctcatcatggaaagatagtggacaatcccaactgatgaacattctacaaaatacctgaccagcactcctcaagactgacaatgtcttcaaaaataaggaaaaattaaactgttataacctagagatgcctaaggggacctgttgaataaatgtgcatcagtccagttgggatccaggaacagcaaaaaaaaaatgtttggtaaaacctgtggaaatctgaaaagagtatggactttcgttaatattagtgtattcatatcattgtattattaatcataataaatgtgtcattgttatgaaatgtaaaatgccaataataggggagactagctgtgtggtatatggcaactctgttctataactgtatgttttttgtaaatccaaaactgtcctaatattaaaaagtttacttaaatatattcatatatatgtataattaagttaaccccaggtattaacaaacttgtgagatgcttatcagcttcctgatgtattcatccatgtattaattcagcaaacattttgtgagagcttactgtgtcaagttgttagggagcaggactgtaatattgagcaaaaaatggttagtctctgccttcgtggagccaagagtctagttgggaagggagacactaatcaaattagcacataagcaaatgtgaaattacaacattcatagataatatgaataagtgctatgagaggttgattctgtagctatccaggagtatgaggacaatttcctaaagtttatatataaacaatgagtaagaataaaataagagaattggtgggaaaatatattttacgcagaggtaataaaaggtacctattcaggaaaaaaagtaaagagatacaatcatagcaatggatattatttttttacggaaattttcacttgtctagggtaaaatgaaaatgtttaatataagtgaatttttcataagactcaatttattttttaaggataggtctttaattttatatattgtcttcttacatttatggagttaaatgtccatcctcttatcaaatgatggtaatcatagaaaaattttgttttgtctggtatccttgcttaataaaagaaaaggctatttaatcaatgtcattactgttgaaaggtttaatactccaacaaatacactcctcaaaatcattgacccagaatctttacagatagggcaaatctgcatatagtcccaaaacaaccggaaactttgagattaaaaccaggtcactgaatcctgaggctggaagaaaatgatgatgttatcagcagaatactaaccatgacaaatgggtcaaattttggaaaatcacagaaaccatttccacaagtctctagaagtctggtcttttataagtctacaacgtttgtgatattaattgaccaagtaataaaactatcacacacacacacacttgaaatatagtaggaaaaacaaatatttatcaaaatttaggcagcataaaagacagaggtctgtatgactgagttgggaagcattacaagcaaccagtattaaaaggtatttggatatgctggatctgaaaagaggaggaagtataacctcaaaactctccattgtttaatcaatcaagggagcaaagtctactgttttgttttgttttgtttttcagaagtctttttgtgttgtggaaaatgcatgagtttgatgttatcaaacttgggaacttgggtacaaaatcctagcttctctagttactagttatgtgtacttgacttcaatttgctccttagaaacagaaactaggtaactttaagttactgtgagcattcaatctaaaaagtgctttaaacattctgtcccttatatgatgctgaaacatttgcaatttttcttctttccagttgaattctaaattaaatgatgtaatccataaaccatcaataaatggcagcctctatttgtttattgtataagagtttacacatctttgttgatggaataatagtctttgggattctcaagaatcattatttgggtaatagaatgttgatgaaactggacaaaattagttgaaataaaattgtggcatcttaagcagctatgatctttgccaagtgatacatctgtactgcagtttcctcctctgtaaaagagacagagaggaggcaggtaaaatgctaacctccctttcagctagcacttcatgaatcaatccttcccaattatgctttcctactggaatactgaaattaataccaatctgtaaatagagataattttacatgacatttctattaaggttacttacagatgtaaaggaatctcctctttgattctgattcttccctatataccctatatgtgttgtttatttagatatattttgttactttgaaacatatgtgtatgtgtataaatgtatatgtatctatatagaaatatacatatacatacacatatgtatatgagatattattctagccttaaaacaagagaaactctatgtatcggtggagtaaactgttgtttttccccacctgacaagaattctagatggtagcatttgctaactatatttcagtgtgatggtcaaattaataatatgtacaagaaccaatttcctttattttttaaattaatgttttaaatggataatgaactcattacaattgtacattttaatggggtacattgtgatgtgccaattcatgtaaagattgtataatgatcaaatctaggcattttttacagtcattacattaaacatttgtcatttctttgttttaataacattcaaaatcttctattttagctacattgagatacactttacattgttatttgctctagtcaccctactatataatagagcaccatatcattcttccttcctgtatctctgtattcattggtcaacctctcccaattctccccttctctttcccttccccaggttctggtaaccaataaccaatattctactctctacttctgtgaaaacaactgttttagattctacatatgaatgagctcatgcaatgtctgtctttctatgcctggcttatttcacttaatacattgtccttcaggttcatccatgttgcagcaaatgtcaggatttcattatttttaatggctgaatagtattccattgtccatgtttgtgtgtgtgtgtgtgtgtgtgtgtgctatctatttatccatctatctatctaccattgtgaatagtgctgcaataaacatgggagtacagatatctcttggataaactgattgtcctttggatatatactcagtaatggaattgttgagtcatatggtagttctgtttttactttttgaggaacctccctacagtttttcacagtggctgtacactcccaccactggtgtgtgagggttctcctttctccacatcctcgccagcctctgttattgcttgtctttttgataaaagctgttttaactggggtgagattatatctcattgtggttttattttatatttctctgatgattagtaatggtgacaatttcttcatatacctcttggccattcatatttcttctcttaagaaatatctatttaggtcttttgcccattttttaatctgatttttttagttgagttatgttccttgaatattctgggtattaactccttgacagatgcatagtttgcaaatacatctgtaggttgtttctttactttgttaattgttttctttgctgtgaggaagccttttagttcaaagcaattccattcatcgctccatcttctatctatccacatcatttatttcctatcatctgtagagtattggcttttatcttatggccttcaagtcctggtcatggagggcgacaacagctacaaacatcacttcagtttcaggaaggaaagaaaaggaagagggatgagtagaatcagccacacctgtccccttgtatcaggtaagagaaaatttcccagaaacccttttggtagttcttctcattctgtttaacaaaatccatgacaattctttatggggtcgggtaagacaagtttggccagtacttaactttcctatcctctgtagtgccatatgacacagaagtggtggctgtgaatagcttctggatcagtcagtcagtagtatttaccacattgcttaatacggaagatgtattaattctaaagaaaaagcacggatagccagtccctctgtgggatgaacacagcccttcaggattcacagacacacacacaaataatttaatcagttattagagtgtattctacaggcatttcacccatctttctatattttacacacttacgtgcagaagtgaaaaaaaaaaactgtttggaagctatatatttaatccatagagatctgctgtactaccacttgcaagttaaaaaatcattttttttccataaaagcgttggttttgaaaagcaaaaaaaaaatcaaaaaacaaaaaacaaacaaaaaacaaaaaaaaaaccttctattctgtctgccacattgaaaaggctcaacaaagcttgtaggtgaattgaaaatcatgatggaataaagactaacagaaggaagatttaccaaaaatgaactaaagactgtgattagaggttgtggagtgtggtgctgacaggcatgggtgtcactgaagctgacattttcttccttttttatagccgctgacatttctgagtcctaaagtctactttttagcattagtatgttgctgtctgcttgtctgcattgttattctttatccaccaaaatgtgaatgtcagacaaagaggtgccaaccaaaaatgggttagtgtgagtgaaataaataattgcagagagagtcatttaagtcagaataaaagcaagggcaagtttgggcactgcactgcattcagattcttaacaatcatatttttacattttacataattagagtttatgtcaagaagtatgtcaggaaagtaaaatatttcagtaaaatagcctgctttgtagcttggaacagtactcaccggaacttaatttttttaacaagttttaatattggaaattatcagctgatttttatttaccacaacccaaaacatctgcgttgatttcctctccttcggatatatactcactaatgagattgctggttcatatggtggttctatttttattttattttattttattttattttattttattttattttattttatagatggagtctcgctctgtcacccaggctggattacagtggtgcgatctcggttcaatgcaacctccgcctccagggttcaagcgattctcctgtctcagcctgcggagtagctgggactacaggcgcacaccaccacacccagctaatttttctatttttggcagagacggggtttcaccatattggttaggctggtcttgaactcctaacctcaggtgatccacccaccttggcctcccagcgtgctgggattacagggtgagccaccacgtccagccttattttttattattattattattattattgttgttattattattattattattattattattatttaggtggagtctcgctctgtcaccagactggagtgctgtggcatgatctcggatcactgcagcctctccctcccaggttcaagcgattcttctgcctcaggctcccaaatagctgggactgtgggcatgcaccaccgtgcctgtagaatttttgtattttttagtagagacagggtttcaccacgttggtcaggatggtctcaatctattgaccttgtgatctgcctgcctcagcctcccaaagtgctgggattacaggtgtgagccaccacacctctggctcttatttttaatttttgaagaacctccacacagttttccatagtagttgcacgaatttacactcccaccaccagcgtacaagcgttcccctttctctaccccttcgccagcatctgtcataataaaatggagcagttttcctgaacatagtttccttccctctgcctccaccacccttttgtccaatgagccctgcctgcctgcccccatgcccctctttgctttgcttgtctttctggccagggcagctccagctattagcgtttcagcagccgtggaactatgaccctgcacaggggccaccccatagcataccaacgctgctatctccttcagtgcctagggctggagttagcatggccttcatcacacccaaagagaccgaagctaactccctgggacctgcctcctgtcccgggctcaagagaacacagcaggaatgtggggtaattgatccccaggtgacatactttgtccagtgaaagaccagggcaaagaaacagcctgctgataaatttgctcactcttgctcaatagacgagctgtttggatttgggagtgcagtgatggcacaggccccagagccaaagcacacttaatgaagcagtgcttcactgagaagctgaggccagttcagggatctgagaactcccacttcatatttgttttctgctggcctgccttgctggccttcacctatgaccctaagttccttaggctcaaatatcttccctaatcaattgttaacatgtgagactttgcctcacactctatttctacagaagcaggactaaggaaacaactttcacctctaaatgttcattgcagagtactgaatattccctaggtgattcgctctcacctcctaccaggcataggagtaaagaggtgtaagtgaattgtgttaagcagtagatgaaaggccattagaaaattacaaaagaaatcactttgagtgggcagttgctccactgaacatgttttagaaacccctcattctaaaatggagcttcaaagccaaggacccctgatgagggagcagaggtggtcacacacgtcacttgagggtgctttgagcttcttatgtatgaacactgtgcatttcatttatagaatactggctaataatataccaatggtaaaactattttcttcacctgtgactaaaagtaatactgataaacaaaaaacaatttttattatttcctgaagcccacggtgactgtgctaggtaggtacacctgcccctatgagaagattcccctccttctcatactcctatagcatcttgttataatactcgtctcagagacttaggattatttattgtatgtttgtttctatcacctattttatatatatatatatatagagagagagagagagagagtcatttctgatgtttggtgaattcatgcaaaaatgaatgattcgacactgaacatatacccatagatatttgtaagtgattgcgacctactttcaggcttctgattcacagttgtatgtgtgtgcatatgctaatcttaaaatgatgactgagacagataaaattggataattcttgttataggaaaataaagtttaagaaagctcactcagatataatatctaatcatcctaaggcattgatttactgttaatggatatgttttgaaaagcaacatggcctgattttaatttttatacatagtcatgagaaataaccaaagtaaaagggcataaaaggaaaaatatgagctgaaatgtgagctctagaagcaaaagtcatgtttaaattcttctcttctcatggtaaaagtagagttttctcaacagttagaggtgatatatggtcatcttgtatccttacactaatgtcgttatttgtcaagtgaatttatttctatagaataatgatctctctaggttctaacacatttgttaaatagcattggccacacatctctaaaaaattggaggaatgtttctagctttttggttaaatcttcaaaatggttctagctttttggttaaatcttcaaaattgattttcaccagaaaatataccctgttaaacagcatcctgcattgtccatctggagagcacaactccccagtcatcaaggtgtcttgtatatgaaagctggaaattaaaaaattggtatcgttaagatacaatttaaacatataagatctttgattaaactggcaatgtaattttaaaaaattctatccttaaaggcatttaaattcagaaaagaggaatatttttaaaggaagatttgaatttgattgaatttccctgctggtctaaagaggtcatcaaagagaatattattactactaaaagtacattacaaattactgctaaatcaatgctgctaaaagttaataaacaaaattcagggatttaagaaacaggacaatatttaaaacaaatgtgcacttctgtttcttaaattttttaagtaaattaattccaagcagatctttattaaaatcagttgtaaaactggctctatttaatggatctataataattgaacttactttaaccactttaagaggttaccattattaacattcagtggaatgagtttctaagaaaaaaatgtgcatatatttgtcattttcccaaggatttcctgaaagtgaatattattcctttgaatgttgtccgtaatatctaagcagatatttaattttgacaacaatatagtttataaattttagtaatttgataaacaggataattctcattatcatttcagttcttgagtatgaagcatattgtttgatttgtaatatatgcattccataactttatatttgtccccatgttttagaaacagaatactcaaattttaaaatcatagttccagtaaaaaatgtctaatgaaaaagtttctatttaatttaactgaaaatttaataacttataagtatacttcttatatataatagtcttatttctttaataactgtttttaaatgtaaggtttcattaatgctagtgattcctgtaggaaaaaaaataacgtgatagaatcaaataacaagaataactggtgaaagttcttaataaaataggatgatcttaattctaacattttttaatgtctggaaaaatatatatgatattcagcaaatactattttcagtaattacctgtaacatctcaacccatttatgcctagggttccattattggaacgctaagcatgtgggagttatttatattctactgctcaaggtcattaccaaggtctgattgcaaaaactaaaaaagactgcagcctcaggcataaataggttaaaatactattttttaccattccatttcaaacagaatatgaagattattttcatcttgggtatttagtatattctttcacttaaaaatactattcaaactccagtttctgaaagagtacatctatatttacctgatatttttatcttttggaaataaaacatggaattccgtttgcttatggttggtaaaagatattttttaaacgtgtgccttaattatatttttactttagaaatacagtaaagtgcagaaaaacattaaagtgaaacatgtagcaacaataatggctcatgagtgtaatattaatgttttatgagtatatattacatatacttgaaaatgtgtatttttctttacacatataaaacaaaattgccagcttcctatgtttatggtattatcttttgttcatatgtgatcataaacacttcctcagaacagtaatcatattctgagattacccacttttaatggattaatagatgtttggtttttttgtgtatattatataataacttacgaatggtttaatatttgacatgtaagtcatttaaaatattttattaatccaatgaaagcctatggatttttttggtgtaccagtcaatgaaaacattgctgactatttatttgcataagaacatgaatttttttattctcatgaacctagcttgactttatgtaatgtgacaacaatgtgtgaaagtatattaacatgctgttcaatatttggcccttattggttaagatcacattaatggttttaatctattgatgtttgatcatatgcaaaagtggcatttcacattttcacatttttatgaattttctcttacatagatgtccttttctgtttggtcatgtttgtttggcactctgtgcactaggtactgagtgtggtggtgcaattatgtcagacctagtctgttcagtcctacagctatgaaggagagcatatgtatttttaagaagagtttattatatagtggagctactaatcattttgtaatgttttcttgttttcaagttcgtttatgggggctttatgaatagcccactttttgaatatttatttttatgtagtgttcacattaacttttctactgaaatgaccttctttgaatttgattagtccattgcaaggccaaacacacctacttctaaaatatgcctcctgatgaaggtaataacagtgtgagaataacaattgacagagctatcattttcctctacatttgtggggtggcatcttgagtgactgcatagcatgcccaaacacacctcagctccttttctgttttccagactccaccataccaaagtagcaagcccaaggcccttacttctctgatctgcatgttgggtgccaaatttcttgctgtttggggtttaaggtttggatgactctccgtgagggcactgctgctacctctgtatcgttgattgcttgtgtgtcctctgtagggctagtgtgcagggtcggcagtggaacagtgtgagccacaaggagacaaaccaaatgtgagtctgtatttccttttccatattcttcaaacatgtactggtctttcaaatgtgaatctcatagactatttctggaaatttctaaaaaatatttctaaatgaagagatcacagaaatgttcattcatatcttcttccaggaaacttctttcagcctcattttgtttccttgaaatagttcctctttccctctgtctgtattcaattgttttttctttccttatttttcagcagttttactatggtgggctcaaaattagtagattttcttaaatttgtagattaatggctttatccatttggaaaattttcagctcttccacactattccattctctctctgcttttcttccaggatgccaattgcatgcatcccaaaaatgttttacagctttatgtcttatgctcaggtctttgggttaatttttgaatataatgtaatggaaggtccagcttcatgattttgcatatgaatttccagttttcttagaatcattagttaatacgactgtcttttttccattgagtggttttggcatctgtgttaaaaattatttgaacatatatgagggcttatttctggactctattctattctatgtatctatgtgcccgtttttagacctatagcacatagtttactgtagtaggaagttttgaaatcaagaaatacgtgttctctggtattgttctttgttaagattgttttggcaattcgggagggcccttgagattccacgcaaatttttggatagattttttatttctgtaaaacacctcattgaaattttgataaggtttgagggaatctgtgagttcccttgagtagtgttgctgtcttaataatattaaatcttcacatctatgaagatggaattttttccatttatttgtcttgtttaattttttaagaaatgttttgtagattacattttataagcgtttcacctcttacttaattcctaagtattttattctctttgatacttttgatactattataaataaaaattttaagttttcttttcagattgttcattgttattacatagaaatgcaatttattttgcatgttgaatctgtaatcagatagttttctaatttattaattataacaattacttttggataaagctttagaattttccacatatgagatcatatcatctatgaacaatgataacattattttttccttttcaattctttcttatatttcttttttcttgcttaattacagctgctaggacttgaagtactgtgtcaaataatatggtgaaaagcaggcatctttgtcttgttcctgatcacataggaacatattatccttttcataggaaaaggtttcagtcttctaccattgagtatgatattccctggcggtttttatgtatggcttatgttccgttaaggtagtttccttctatttctagtatgtggagtgtgtttatcataaaagagtgtagaattttgtcaattgctttttctgcatcagttgagatgattatctgctttttgctttcattttgttaatgtggtgaactacttcgattgattttcatgtgttgaaccaatcttccattccaggaataaaacccacttgataattgtatataatctttttaatgtgctgttgcactgttgaatgtgctgttgaattcactttcttagtattttgttgaggatattttcattaggttcataaataatattggtccatagttttttttttttgtttttttttttcttctggtgtctttgtgtggctttggtatcagagtgataatggcctcgtaaaatgagttaggaaatgctccttctttattttttggaaaagttgaagaaggattggtgtagtacttctttaaatgtttatacattgagatttgacataaaatacatttttagaaaacataataaatatggaacactgtgttatatgttggcaaagcaagaatgtgtcaaatcttagtgttaacttccctcattagtcaggaaaatatactaacttgatgatttccattattgttgcactgctgttcttttacttatgttaaaatcattgacaaagtagaaaatgaggtttctttaacaaactacaagatgttgagattatacaaagaaagaggttaaatcagcttctagtaaaagaagaattaagaagcctgaccagttatagattttcaaagtccagtcctcagtgataagatgcaaagcaccaagagcacagaaagagaaaatggcattatgtttattcagagctagaatcctcaaagcatttgaaaagatagaagtggcatacagtttacctcaaaagatagctaattttttctgataacacttgttagggtcatatggacattctgctagactgagggaagttaaaatgaataagacacatgtctcttcttaaggattacactgcatttagtaaacacatgcagcaagaggaatagcagatggaaatgtagacccaaagagaaagtcaccagacattctttctgagtcctcagaaaagctttcatggcagatatggttttgattatgtggtacatgggcatagcctttgtgtcagactgaattagctggtgccaatttcagggtgaattaaaggatatttaatctctgtgtacctcagctaaacatgaaaataaaatagattcttgctaggtgaaaaagtgagaggatgagagagaaagagagagagagagacagcaagagcaagggagggtgggaggaacaaaagagggagagaaaaataaaacagggatgaactgagctttggtgggtgatatgatttggccgtgtgcccacccatatctcatcttgaattatagttcctataatgcccacatgttgtgggagggacctgattgtggaggtaatcgaataatgggggtagttaccctcatgctgttctcattatagcgagtgagttctcacaagatctgatgactttataaggggcttttccccatttgcttggcatttctccttgctgccgccacgtaaagaaggatgtgtttgcttccccttttgccataattgtgtttcctgagggcctccctagccgtgctgaactgtgagtcaattaaatctgtcttctttataaattacccagacttgggtatgtcttaattagcagtgtgaagatggactaatatagtaaattggttcaggagtggggtgtggctataaggatacctgaaaatgtggaagtgacttgggagctgggtaccagttagagcttggaacagtttaaaggactcagaagaaaacaggagaatgtaggaaagtttggaacttcctagagacttagagggctcagaagacagaaagttgtggggaagttaggaacttccttgacacttgttgaatggctttgaccaaaatgctgatagtgatatggacaatgaagtccaggctgagatggtctcagatggagatgaggaacttgttgggaactggagtaaaggtcactcttgctattcaatgagactggtggcattttgcccctccccagagatctgtggaactttgaacttgagagagatgatttagggtatctgatggaagaaatttctaggcagcaaagaggaatcagagcataaatgtttggaaattttccagtctgacaatgcaatggaaaagagaaccccgttttctagggtgacattcaagtaggctgcagacatcagcataagtagtgaagagctgaaagttaattaccaagacaatggggaaaatgtcttcagggcgtgtcagagaccttcatggcagcccctcccatcacagccacagaggaaggaaaaatggttttctgggcctggtccaggcccccctgctatgtgcatccctggggcatggtgccctgcatcgcagctgctctggctatggctaaaaaggccaatgcataaagtataataataaaaaaaagggggccaatgcgcagttcaggccgttgcttcagatgatgcaagtcccaagctttggcagcttccatgtggtgtttgccctttgagtgcgcagaaaacaaaaattgaggtttgggaacttctgcctagatttcagaagatgtatggacatgtctgggtgtccaggcagaagtttgctgcagcagtggagccctcatggagaatctctgctagggcagtgaagaagagaaatgtggggtaggcactgcccagtggagctgtgagaaggccaccattctccacaccccataatggtagaactactgacggcttgcaccgtgtgctgggaaaaggaacagacactcaatgtcagcctgtgatagcagccaggaggggagctataccctgcaaagccacaggggtggacctgcccaaggccatgggagcccacctcttgcatcagcatgacttggatgtgagacattgagtcaaaggagatcattttcgaaccttaaagtttaacaactgccctattggattttggacttgcatggggcctttagcccctttgttttgacaaatttgtcccatttagaacaggtatatttactcaattcctgtacccctattgtatctaggaagtaactgacttgcttttgatttcacagggttatagatggaagagacttgccttgtctcagatgaagctttggacttggacttttgagttaatgctggaatgagttaaggctttgggggactgttggaagggcatgatggtgttttgaaatgggaagacatgattttgggaggggccaggggcagaatgatatggttgggttgtgtccccacccaaatctcatcttgaactatagttcccattagcccaatgtgtcatgggaggaacccagtgggaggtaactgaatcatggggatggttaccctcatgctgttctcattatagtgagttctcaggagatctgatggttttataaggggattttccctcttttgcttggcacttctccttgctgccacaatatgatgaaggacgtctttgcttccccttccatcatgactgtgtttcttgaggcctccccaggcatgcttaactgtgagtcaatgaaaccacttttcattataaattacccagtcttgggtatgtctttatcaatagagtgagaatggactaatagagtgggcctggggagagtgaacatgagcaaagacactgtgctgtggcaggacagggcctacatcctagagttcatacatacaaggacctgatacagaagtgactcctgagagacacatgggccaggatgtggaaggatttgaattatatgtgattttgttcttttgtttctgaagtaatggacagtgtgtaattacttaagtaaaaaatggccatttcaaatttacatttttaaaatgctcctgtagaaacaataggtgcatatataatagaaggtcaaacctaaaatattattcttaatcatccatcttatcaagagcacataaaattataagaatgtgcacttgcatttatgatgttcttttgtgttaaatgataaatgggatgactaaattccaaaatctgctctgcaacaaaggaggtagatcacttgcagaagtcaccagtgataaggagtgacaagatgctaggaaatcctactgagaaggttatatttaagaatcaataaattctatggtcatgtttcataagactacatctctcttttttgaacagaaatcaatttaaatttcatcatatttactctatattttctactgatacttcagatgcctctctctctccatgtttcatttcagcccagaaacaattattattgtaatataagaacttccttttaaattataagtattcctttcaaatcttgtatgcatggtatgaattctacattttgaagccatcagaattactattgtcaatctaaaaaaaattagagattagtatctccaaatatgttgcatttactcaggaatgaaatatgaggattaatatttgggatgccacagtgtatcaagtgagggaaggggaaatggaagcttttattggcacaatgggaagggattacataagttgcttagaaacaaagttctttggtttcacagactcaagctcagttcgttgttggagatgtccttactcggcaagtgttcttggcagagcatcctattgaaaatattgcagtcctaaagaatgtctagtgatagaccttgtcatacaaacataagtatatgtgcaaaatttgcaagccatgcaaaggataagatgcttgaaggaggttaagaaatttcttgtggagttttagagagtccttggaaacagttcttttcttagacatgtaatcatgagttccctctccttcatgtcttcccagccctattttgtctggatctgacaaaaacaatcatccagtatctgcaggtttcacactatagacattaagactcaagaacttagagggtttttggttgtttgattttgtttgtttgattgcttgtttgttttgctttttaagtgattagctttcaaggcaaagttaaacttcaaattcatgagtttaactttgttgtaactgagctattctctgtcttcattcattcaacaaatattaattgagcacctactaagacctaggccttctctaggtgcaagtcggtgcagtatagactgagacagacagaagtctgtgacctagaacttacattctagtgaggggagcaaataaattacaaaagaaaagtattaaaataagcagttattagatactgataagtatctctatactgataagtatcctctatactgatagtatagaggaaataaagatataattaagcacaatgtcacatttttagtgtgtatgggtgtgtgggtgtgtgtgtgtgtacatgtactatgcatctgaaagtatcatcctgtctgatttatttgaggtactgcaatttttcttttagcagaaaatattccaatacaattctagaaaaaaacaggaattcaagcataacatattttttttattgaataagtctggaggttcccatttaagcaaatacgatgacctaggcttggttttgaatagcatattttaatgaatgtccttttaagaaaatactacacaaaagtgtcatttttaactttctgttctatgttttgggtcattcatagaactaaaatcacatattttgggaattaaaagatagaaaaatacagaattcccaagctcaaagagcctatagttttctagaaatcaaagataattataagaatgacccaatgagtttccttatcacaactgcagcataaaatgaaataaactgatatttaaaaaaattgaattttatattttatgttcttaaaaaaataagaacttaacactacttagattttgtttcctttgtgtaggtcacaccatcctgaatctaggtatgctctttgagaatacacatgagagcaggcatggtggctcatgcctgtaatcttaagtactttgggaagccgaggcgagtggatcacctgaggccaggagttcgagaccaacctggccaacatggtgaaaccctgtctctactaagaatacaaaaattatcagggcatggtggcggcgcctataatcctagtgacttgggaggctgaggtgggagaattgcttaaacctgggaggcggaggctggagtgaactgagatcacactactgcctccagcctgggcgacagagtgagactcaaaaaaaaaaaaaaaaaaaagaaagaaaatacatgagccattaaaccaatttatatgatagaaaataactagcatcaaaaattcttggagctgcaaagccctctgtcatagacatatcactcagcctcagttcctttttgcgatagtcatcctgaggaaggatattcacaatacattttactacccaatggaaggaaataggtcaaatcaaatgtttcttatgcagtaatacgaattttcttttttgctggaagtctctataaagtttcaaagtgtctataaatcccctggaactgtaagtaaatagcaaaatgctgagcttttttttttttttctgctagaggtcaggtaagtttcttcagatttgttttttcttttctttttttttttaattatgctttaagttctagggtacatgtgcacaacatgcaggtctgttacatatgtatacatgggccatgttggtgtgctggacccattaattcctcatttacattaggtatatctcctaatgctatccctccccgctccctccaccccacgacaggccccagagtgtgatgttccccttcctgcgtccaggtgttctcattgttcaattcccacctatgagtgagaacatgcggtgtttggttttctgtccttgcaatagtttgctcagaatgatggtttccagcttcatccatgtccctacaaaggacatgaactcatccttctttatggctacatagtattccatggtgtatatatgccatattttcttaatccagtctatcattgatggacattagggttggttccaagtctttgctcttgtaaatagggccgcaataaatgtatgtgtgcatgtgtctttatagcagcatgatcctttgggtatatacccagtaatgggatggctgggtcaaatggtatttctagttctagatccttgaggaatcaccacactgtcttccacaatggttgaactagtttaccgtcccaccaacagcgtaaaagtgttcctatgtctccacatcctctccagcacctactgtttcctgactttttgatgattgccattctaactggtgtgagatggtatctcattgtggttttgatttacatttctctgattcttttttttttttttttttgacacggtgtttcgcactgtctcctgggctggagtgcagtggtgcgttctcgatgacactgagagagtccacactagctcctgaaagagacaacaatgctgctgtcacaagcatatcccagcatagcacctgaacagtggtagccctctaggttttagtttagacagtatctggaaagaaacttgattgctaagatttactttagtggtggaaggatgatgcattagtgtgcctgtaacagaagaataccagtcttcttactgtgatctggcaccgaccacaactgtgcaagtcaaacatgatgaagtccccgcagatggagctgcccttctgctgtgttgtgctgaacagccactgacctgggtgggcactgggtccatgcgttgtttgtttctctctgcctggaaagcccaaagtgcttggaaaggaaagtgctctcagtcaaggaagcctgaggccagtatttgggaagaaggggcaggcattggctctgggtcattcatacagaattttcatagatagaacttacttgtctgctacctgaaacaagaacacaagaaaacaagaccgtatgctttggcagctgtctgaaaaatgagtttccaagaaatcaagcagagatgaatataatttatgaatttatcttctgtttttcatttttaaaaggcttaacgtggccttcatttatctgaatccattttactttgtggtcatttatagctcttgctggttttgtagagtgatgtgttgggcaaccctggtctaagccattctgctccttttacagccagaggattaatagcttaaataactgtgatccaaaagcagccggttttgtgatacggacagaaattatgtcctttgatctctaaaagccttcaagttcaaacacagcctttattttagtcaaaattatactccctttttagctacgtataacacaaattgttctgataacataaaattagcattggtttctaagaagtgtaacatggaaaatgcctttttgaaaaacactgatttgtcttatttgaagatcagtcttaaaatgatgcagagaatttagaattttcattatttggaaatagtattactaccaagagtagaaaatttttaaaactttgctctctgaatgcattttattactaaaaatatttattttttaatatttgactgtatataatatagcagacactatattaatcatatgaataataccatgttttaaaaataaatttaaattgtaattaatgtatctttttgggttttctaattaaattttaatttgctttattgatattaatgttataattaaaaagtaagtatttttcaaagcaaattattgccagtatctttatattgagagttcacttataatttaggtttcctagagaatggttgtaaacagaaatgaaggtatactatgtccaattgataaacactaggatattccaccagtgccacttatgagaaagcatcaatggattcattttccctctatctgttcattccccacccagcctgattcacacatgattgtcacccatttggcacctgagtgtgcaaatcctagtctagagttgacaagaaaatagaagggagtatgaaaactacagtgtaagaaagacatctttgctcagcattctttaaaatgcacttcttatcttcaaagggaattcaagcttactttatattaattataatcactacttattaagctctatattcctgtcaatttttccaacaaatatatgcagttaatgtcattattgatgttttacaaatgaagggatctagatatttgataattaatgatctgtctgaggatatttagtaataattacaactggaattcaacaccagatctgtctgactgcacagcctgacaaagtcttatgcaactacattttagctcctgtgttgaacttatcctcattcccctctgcagcctccttggattgtttggattctgtaaagggggcatccttatgccattgtctctgcatgggatctttcatttccatgttctagcacttatcaccatgagtcacacttggtagaaggtcattaaaagattttagaagtaaataatgacattctctcctgtcttcatttcattaatacacacacacacacacacacacacacattactgaggactgaggatccttataagcctttaaaatgttgtgaaagatttaaaagtttagctagagagaggaaaaataaaacaggtgtttttgaaaaatgtgtattctgggggttgttttgatgacattttagattttcgaagttttaaacaatggagagcttcgttaaaaaaaaagtaaagattaaactaattttattttctaatgataaaagttatatttcaaaataataataattataaaatacaaagcagcaaaggaagcattcatgtaataacccctaaataaaaaacaaaactgtttgaattttgtatttataactgtcagtatcattgtcatacacatatgtctacttatgtatgcacattaaacataaaatcaatttcggttcacgcttacagacattaatctaaatttgtaagactggatgtatgcccaaattatcaatctttgtgcatgtgtatatatatgcatatataaatttatatatgtttaatatacatacacatatatgcatacatacatatatgtatatacatatatgtaggtatatatgtatgtatgcatatatatgtgtatatgtaatttttaaaatactgcataaaactgccttgaaattagaacattttgtaagcatcgtatcttatcaatcttatcaatcttatcaatcggtaaatatcaccataagcatttgtaatgaatgcacagtgttataaagttttggatatattgattattgtttagcataataaatacttcagtgtatgctacatatgttttaattgctgtgatttttccacttactttatactctctgtgtgtgtatatttaaaaatgttagactgttaaaaattagtggcttggccgggcgcagtggctcacgcctgaaatcccaccattttgggtggccgaggcgggcggatcacctgaagtcaggagttcgagaccagactggctaacatggcgaaaccctgtctctactaaaaatacaaaaattagctgggtgtggtggtgcacgcctgtagtcctggctacgcgcgagggtgaggcaggagaatcgcttgaacccgggaggcggagattgccagcctgggggacgagagtgagacttcgtctcaaaaaaaaaaagaaaagaaaaagaaaaaaaaatttagcggctcatggctcatgcctgtaatcccagtattttgggaggccgaggcgggcggatcacgaggtagggagatcgagaccattctggccaacatggtgaaaccctatctctactaaaaattaaaaaataaaaaaaaattagccaggtgtggtggtgggcacctatagtcccagctactcaacaggctgaggcaggagaatcgcttgaacccaggaaacggaggctgcagtgagctgagattgcactgctgcactacagcctgggtgacagaatgagactccgactcaaaaaaaaaaaaaattgaagatatgaaatgttctaattagacctactttaagttattgttttattttaaaatgttagtataagtactaacaatataacattttatattgttatattccacttggtacaggaaagatggaaattatctttaaaatggatgtgggtgtgtgtacagattttaaatcttaacaaggaattattttgtatctacaacaccaggaaaaatttctgaatacaatggaagcacatttcttgctgccacagtgagggtaacaggcggacggagttttctgtgctggacatcccactccccattttggttacccgccttccattcctgtgcagtcagtagtttggttagttaagtgtatatttccactgaaacatgaataaacatgaatagattatattaccctaatacacaattaaaaagctacaaatttcagtagaaatcagcttacacaatttattttcttgccaaataaatctattaatactacacacagcagtattcaagcattgactcattctttttgaatatttttacataatcctgggataacataaattgttcaagtataaagtattatgaagttacagagaagaagtatttgaaaagttatgatgatatcatttgactaagaggcgcacaatttattagtatttccactttaaagaatattacttcttcaataattgacttaatgtcttgttctactttattattttattattgtattcgccacattacaaagacaatctacacataatttctaaaggccattttcatattttgcaaacatagtttttacatattattattattatttacattttattctagttgttggcatatcacactgtcttgtcattctctctagtcattaatatactacctcttttctgtattctaatttctgatacagatattctaatgtaaaatataatatattctatattctaaattgctcccactttcttgccttatttttgagccgtggtaggaaatacaccatacattttattattttaatagtagtaatgttatgtaataaaccattcaaaggatagagatggtaacattcacatatcagttaataagttgatcttttccaaggtaagtcaggtatgtactaagggaaactaacaaaaacaaaaaattataatataacaattcctcacaggtaaataattctgatggtctagtaaacactctagtgggacagaaagtagatctctgtgggagaaaacatctcaattctgcaaacgctcccaagggtgggttagcaggacaagacgtctgtgcttggctcagaagtttggctcaatcactactttctatcccgtgttttgctcaaccactactttctatcccgtgttttgctcaaccactactttctatcatgaagtgtttactttcatagctgatcttcaagtttcctagaaagatggttcagactatttttcagattaaaaaaaaaaaaaacattgcagtttacgaagctacatagtacattattgaagacaagggcccacataaaatattagttgaattttagaattctttataacaattcatatgaattagcaaaaagtagatttccacaaagtactcagtatagattttttaattgattaataaaaatgtttagagatcagttttttccatctgtatttccaggctatgctgattttagctgaaggcatatatgagtaggttcagagattccttagcagagccagaaggtattttgaaatgattataataatgtaagaagtacatggtttctgtacctaaccttgctcagatcacacatatgttctcaaattttcttttctttttacattttaagtgagaaatatcttgctagtaaatctgttcttgtagatgtgacttttgttgattttccaactttgtgtactttttctgtttaaatgaactgttatttcacactagtcagtaggataaaagggaaccaaaaaaggacaaaataaaataagtcagtggcatgatttataaatgaaaatagtctgcattacttctgctgtaagtgtataccatagagagttagcatgcttaagtttctctacaaagctattggaaggtaattattttattcagcaaaagcactattgaagaaagactttgtgtaatgtcctttatccaagcctaatgttcatttttattaggtttttaaagtttgtttccatggcatatgacagaggaaatgctttctctggagacctactttaaattcttataaaatgtcattgattaaattttcttaaagtaaatgttagactctatctggagtcttgactgaaaatgttcaacacacatactttatcctttagcgtttggatattgcgcttccctgttctcttgagtgctaaaacaaattggatataatataatttcaaagtgcaaaaaataaaccacagaaagttacactctgcattcttgatagataatcatttagtattgtttgaacacaggcttttggtttctctgagttaaaaaaattttaaagggaaatcttttccaaactgtttacataagaagtgtgggataattttgatagccaattttaaaaagaaaaaatctgtttatatatgttgttttatatgtgatgatttcagcatatcaaaataggatattagtatatattagctcactaaaaataatctgcataaaattctggggaccttgtgttaccatctattgttcttctcacttttattatttatttatcattgcagattaaaaaaatcaacagaaactttcctgtaaaccagcaggtaagatcaaagcatacttggaaagctaaataatatatttctttaattttattgattatagaagataacgttacctgatttctagacagaaataattggtactgtcatttactatcttcagtgagaaacatacatttcagatatctccttcatattatgtaatatattggttcctctacttatattaaaaagtactttaaaaatgtttatctaagtcaaaaattattgtttctacaaaataatttatttgaatacattgttgaagaacttagagttttatttacatatgttagttttagtatatcttaacttctgggagacctacttttaatttatctcaaaattcaaatgaatttttcacaatttgctgacagtatttcaaacgagtctaagttaatgcatagaacaaaaataattttgattattcagttctataaacctcttactcttgatatcaactttgatttgaaaccactgacaaatctaaatatctatgatagctatttataaatgatacataaattacaaattaattttaatgataaaaatgtttaaatgctcttcaacttataaaatgtaagatatttttcttatctaaacctcagttcccctatgtgcaacatttgtgtaagggcgactatcctgtaagtttattttgaggattaaataatagcacatgtaaagttctcaatctatgctatcattatcatcaaagtttctaaatgtttacacttgttctttggaatacagaatttatgttttgtagaaattgtatcattaatgatgctgctagcccaaatcagcctccaaagccatgtgtaactagaacactgtagagaacagctttggagagttaattgtgtctacaatgctctgattagttcttttcagctccagaggtcccctccctcctaccttaagtccctctgccctgagccaagttgatatcttggataaatgcagaggttggagagatgtacgtgtcttgccacatgctgcagcagcctgtagttgtttttaaggcccttacttacagtgtggaaaccagagctgtcaccagcagcttctgcttacttgctctgtaacaacacctgggatgttccctttgttgctcccatgctgtcccaggtgattctggtatgggtgtcatcttgagaactgcagataagtgtagttcaagataggtgtcatcctgagagctacagtttaatgcttttacagggttccagtagagggaaaatgtcattaataagaaattactcaaatagaagaaagtatcagctatgagggaagattataatgtccatcagtagacaaggctgttttatagtcagatctttaaaaatggaaatctactgttttgtaagttcctctccaaaataaaaaatggtgaattattttttaatttaagaatgactctagagctgtgtcgtcaccctctcatgccctttctaaactcaacatgggagatattaatattggtgtaatatattactacagaggtcattccgctgatagccccaaagctattctgtaatcaatgacaactacagctaacacttctcatgtagtcagcttgctgactgggagcacttcttgccacctttgcttatacccaggtttagaatagtattaagtaaaataagtgagaatttgaataaatcacacatagaacaagtaataaaaactttaatattctaacactataatattctgacacatactcatatgtaagcatagatgttcattagtattcatcatttttatttgctagcctgttaatattattcattatataataatttcaaatccaaaattatataattcaaaactatttcagattttatttcaattatcttggcagctcacagttttgaaaattgtaacaaattcatcctgatatttaagaaacctgaaaagaagggttaatagacttttttccttactacttcccattgtgtacatgaagaattttaagaaataggattaatttatagttaaacatttatattattgcataattaggaaaactcactgcacagtatgataacaacgcattaattgactagagtacatttcctatttagtaaaatctgagccagttttaaaaacacatataatcccatttctgatgatatctacattaaataactccctcatattcctgatgttctaggtatcaaaacagaaattaaaagtcacccaagctacaatgaatccgaagttctctgctccctgagatttgattttcaatttgtgctacccagatggtaccactaccctaaccagagaaattaaaatgaaagcaaaacatagggagaaagccactgcggtccagctgagacaaccgctaagattagctccacatgaactctgccacactccagaatgcataaggctttcagacactgtgtctgaagaagagagttgggcccaaaattataaaccatatgaggaaataaaccattataaagaaatgcataatctagacactaaagaactatccaaaatatttttaatcatgattttttaaataaagaaatcaaaatcataagacaagaagaggacatggtgctaaaatttgtagttgtaaaaaaaaccaaacaggagttcaaaaatgaaaaaaaaacctacatttaaaattagttaaccaactaaataatcttagttattgcctccacttgaaatcatattagtgtatctcctacttcacttttcatgaggagtaagttttccattttttctatgcatctggaacacattcatgtgcttttgttctattaagattctgatttggttcttttttttttttttttgagagacagagtctcattctgtcacccaggctggagtgcagtggcacaatcttggctcactgcaacctccgcctccctggttcgagcgattctcctgcctcagcctcccaagcagctgggattacaggcatgcaccaccacgcctggataatttttgtatttttagtagaaacagggattcaccgtgttggccagcctggtctcaaactcccgaccttaagtgatctgcctgccttggcctcccgaagtgctgggattacaggcatgagccacaacacccaacctgatttggttcatttttacagtgaacacactgaaattaaacttgccctggtaactttctgttgaaaagatgaaaggcgggacagttgtcttgctgatgaacaaaacagggataactgaatggaagtcaagtgatgttgtgataattctctcaatgtattagaggtaaaggcatataggcccagacaaccaggcctacatcacactactatatgtacctagaccattaggttataatttattatgtgtgtcatttttactcatttttaactgaaatttcttcatcctgaaatatatctcattcctcccacaaaaatatcatttttcaataagtttcttctataattacctgggagtaacattataaagtattaatttgtcattaaaatattaatatagtgagctttatattaggcagtatacaaaataatataatcaaattatttatattagtttaaattaataaggttatacttatttaaaataacatattagctctggtagctattcctatagaaatattgacatttgacgaaccataataatttggacacattattatagatgtgtacataccatacatagaatgttggcagctggaattaaaagtgactagagtcactagtcatgctggggagaattagggaattacaggacactttaaaaatctatttctgtagtggtatcagaaaagaaagaaaagtaggataaattttgtcagttttgcttctctataaaagcaacagaaaaatggcaaaaatagaatcaacttttaacaaatatggaaattcacaaaggctcactgaacccagggagcatttattcaagaaaaacagctgagtcttggtaagaacagtaagctttgtggcattataactggacctggtcccaacccctctcttttctctggcaatatgttggcttacataataatgatgcataccctaaaatttataatctaatcagttgtatatttaattcatgaaattttagctttattgaagatgtgtgtgtgtgtgtgtgtgtgtgtgtgtgtgtgtgtatttagacaaaatattctattaatgaaactgacaattggtctttatttttggggaatgtcaaaaatctatttttttcaatttgagaaagaaactctcctagttctttatacattcaatttattaatgttaaaaacacattatagagtcacacaatctgaagataatgagcctgtttttgttctggtctatttcataacacttggtgataaaatatgctggcactttatgatctaaaggagaatccacctcaaaaaaagtaatgtgtctgtataaattaactcttggaaaatcaaccagctcataaatcatttgataacaaacatgatggatatttcccaggaaaaagaggtgtaaatgttattttaagttaaactaaaggagcccacacctaattatgtaaaaatttatgtattacagttaaaataaaatatacacttcagaagacttggaaaagtgttattcaaataatagaaagttgtatatgtgtgtgtgttgaatttatacacataagtacctgggtttcattattgaaagaactgtcttaattctcattggctttcttttctaaatatatagattttcaaaatcctgagggagcggggaacaaatgtagcaaaattgtcttgttttacattttccagattgttatataaatgggatcatactgtatgtatgaatttttgtggcttctttcatacagcataattctttttaatattgctcatttagcagcgtgcatcaatccatcattctttctaatgctgggtagtattttatcggtggctctactaccatttgtgtattgtgtattatcccattaatgcacatttgcttcattttaagttttagtgtattacagataaagctgatataaatatttatgaaaagtctttgtcttgacatatgtttttattatatttgggtaaaatcctagtagtgtaataactcaatattatggttgtgtattttgaacattttaagaaactgcagaactgttttccgaagggttttacatttcacattgacactagcagggtaaagataatctcgtagatatccctatggtcaggcttttaatttttggacattctaatagatgtgtcatgatctgttaaattttaatttacatttctctatagaataatgatgttgagcatcttttcatgtgcttatttgacatctgtatatattcttttgtgaattatctcttcaaatgttgcccaaggacagaattttttaaatttgatgaattccaattcactgtattttaatgagtcatgcttttgaaattgtatttagtaaatatctgcctaacacaggaaataaattttcaactattttttatcctaggttttttacagtattctttttatttttaatctatgatttatttttatttaacacttgtttcaaaagtgaggtatagattaaagctatttttaaggggaggtacaatagttccagcatatgtgttgaaagtattattctttcttcactgtattattattcctctaccaaaatacaaattgatcacatacatgtgggcctatttctggactccaaatgctgttgccttggtctatttgtatctcatgacacaaatacaaaaccgtcttgaatactgtagtactacgatgtctaacatgagtagtgtaagtcccctagctttgtaattatttgctgttgttgataaaacttctaatattttttattaatgtttttatataattgaaacataataattgtacacatgtttgggggacagtgtaatatttcaaatcatatatacactgtataatgagtcaatcagagtaattgccaaatccatcactttaaacatttatcatttattttggtagtaacattcaaaatctcctctagctatgctgaagtttacactacatggttatttgctgtagttaccctactgtgtaatagaacatcagaacttactcttcctgtgtaactgtaactttgtacccacaggcgaacctctcccaatctcccctcactcttcccctccctagcctctggtaaccactattgtactctctacttgtatgagatcaacttttttttcgataacactgatgattgagatcatgtgatgtttgtctttctatgcatgggtcattttacttaacataatgtcttccaagttcattcatgttgctgtgaatgacaagatttcattcccttgtatagctgcagagaatatatacatatatatatacacacacatatatatacatatatacacgtatatatacacatatatatacatatatacacgtatatatacacatatacatgtatatatacacatatatacatatatacatatatacatatatacatatatacatatatatatgccacatgttctttattcattcatctgtatatgaacatttaagttgataccatatctcagctattttgaatagtgttgcttattgggagtgcagctatctctttgacatactgatttcatggtcttttgagtgtatactcagtaatggattgctggatcatgtggtaattcaattttgattttttgaggaaccaccatactgttttccataatgggtgtaccaatttacattcccaacaacagtacaaaagagttgccctttcttcacatcctttccaacatttgttattttttttgtcttgttttttgataatagtcatttgaactggtgtgaggtgatacctcattttggttttgatttgtatttcactaatgattagtgattttgagcatttttaaatgtaaatgttggccatttgtatgtattcttttgagaaatgtctattcagatcttttgcccattttaaaatccaattacatggtttcttgctattgagttttttgagcttcttatatattacggttattaatatcttgtctgtgagttgtctcttcactttgttggttatttcctttgatgagcagaagttttttgtttgttcgtttgtttgtttttgttttttgtttttttttagtttgatgcaatcccatttgtctatttttgctattgtcacctgtgcttttgaagtcttattttaaaaactccttgcccagcccaatttcatgaagcaatttccctatgctttcttcaagtgcttccatagtttcaggtcttacttaaagttcaagtcttacttaaatttaagtctttaagacattttgatttgatttttgtgtgtggtgagagataggggtctagtttcatttttctgagtatagacatgcagttttcccaacattgttattgaaaaaactgttctttccctaatatgtgttcttgacacttttgttggctataagtgtattgatttattcttaggttttcttttctgttccattggtttatgtatctgtttttatgccagaaccatacattttatttactatatctttgtagtatacttttaaagtcatgtcgtgtgatgccttaactttgttctttgtgttcaagatggctttgactactgggagtcttttacatttccatatgaatttgaacattgctttaaaaaatctgtgaaaatggcattgtcatttgataaggatttcattaaatatgtagatggctttggttaatattgacattttaataatattaattatcccaatccatgaacacagactacctttctatttgtttggattccctccaatttctttcatcaatgctttatagtttttattatagagatctttcatttttctggctaagtttattcttaagtatttctctgtggccattgtaaatgaaattgcttcctaatttttttatgataggttgctattggtgtagggaaatactactaattctatgttgattgcatattctgcaaatttactaaagtcattcattagttataacaactttttggagtctttaaggttttctacatctatggtaggtgtgtatatttattgggtgcaagaggtactttaatataggcatgcaatgcataataatcacatcatggaaaatggagtgtttatcctccatccagttttcccagcaccattgattgaagagactgtcatttccgccaatgtatattcttggtacacttgttggaaatgaattcactgtaggtgtataaacttgtttctgggttctctattctgttccaatgatctgtgtgtctgtttttaacagtaccatgccatttttcttactatatctctatagtataattagaaatgaagtaatgtgattcctctagttttcttctttttgctcaggatagctttgtttattctggatattttgtggttccaaataaattttaggattgtttttctatttatgtaaagaatgtcattggcattttgttaggaattgcattgagtctgtagattgctttgggtagtatggacattttaataatattgattcttcaaatccatgaatataaaatgtctttctttttttgcatcctttttaatttctttcaccaatgttttatagttttctttgaggtgatctttcatttctttgttatttgtgactattacaaatggggttacagttttgatttcattttcagattgttcactgttggcatttagaaatcccactgatttttgtatgttgattttaaatcctacagccttaatgaatttgtttatcagttctaatagttttttggtgtctttggatttttccaaacaaggataatttgacttcttcttttccaatttcgatgctgtttatttctttctcttctttgattgctctagctaggacttccagtactattttgagtaacagttgggaaagtgggcttgtcatgatccagacaaagatgctttcaagaaaggctttcagtttttctctattcattataatactaccttgggtctgtaatacatggattttatcatgttgagatatgttccttgtattcccggtattttttaatcatgaagggatattgaattttatcaaatgtttttacagcatcaattgaaatgatcatatggttgttgttcctcattctgttgacatgatgtgtcacattgattgatttgtgtatgttaaaccattgttgaatctctgtgataaatcccacttggtcatgatgaatgatctttttagtgtgttgaatttgcgttgacagtattttgttgaggatttttgcatcagttttcatcagaaatattggcctgtaattttttttttcagatatgcctttgtctgattttggtatgagggaaaactgtccttatagaataagtttggaagtattcacttctccattttttggaagagtttaagtaggattggtattagttctttaaatgtttgatagaatttagcagtgaagccattgggtcctcagattttctttactgggagactcattagagctccaatctccttctttgtgattggtatggtttggtattggattcttcctgattcaatcttggtaagttgtatatgtctacgaatttacctatttcctttggattttccaatttattgccatatatttttgctcataatagcaaatatataaatttctattgaatttatgtggtatcagttgtaattagaaattcatctctaattttatttatttggttcttctttctttttttcttagttttggtaaaggtttgtcaatattatttatctgtttaaaaaacaacttttcactttgttatcttttgtattgttttatttgtttatttgtatataatttatttctgctctgatctttattctatttttttttccttctactaatattgggtttggtttgctgttgcttgtctagttctttaaggcatattaggctagctgggcacggtggctcactcctgtaatcctaggactttgggaggccaaggtgggcagattatgaggtcaagagattgagaccatcctggccaacatggtgaaaccccatctctactgaaaatacaagaaacattagttgggcatggtggcatgcacctgtagtcccagctgcttgggagaatcgcttgaacctgggaggtggaggtttcagtgagccgagatcgcgtcacttcactccagcctggtgacagagccagcgagacaaaaaaaaaaaaaaaaaaaaaaaaaaaaaaaagacatgttaggctattaagctatttctttgaaggctttttgtttgtttggctttgttttttatgtaggcacttatagctataaattttcctcttagctctgcttttgctgcatcccataggttttattatgttgtgtttccattaccatttgtttcaagaggtttttcaatttccctcttaatttcttcattgaccaactggtcattcaggagcatgtgcttaatttccatgtgtttgtatggcttctaaaattcctcttgttatttatttctaatttcattccattgcagtcagagaaaatgcttgagatgattttaattttttcagtattttcagacatgttttgttagctgacatatggtatctcctttagaataatctatgtgctgaggagaagaatgtttattctgaagctgttggatgaaatattctgtaaatatttattaggttcatttgttctaaagtgcaagattaaatatgattttctttgttgattttctttctggaagatttgtccagtgctgaaagttgggtgttgaagtgtgtagctattcttgtattgagatctgtctctcttttttactttaataatatttactttctatatctgggtgctttggtactgggtgcatatgtaattgctatatcctcttgatgaatttaactttttatcattatatagtaactttctttgtctcctcttgtagtttttgtcttgaaatatattttgtctggtataagtatagctacttctgctattttttgtttcaattagcatggaatatctttcattattcctttattttcagtctttgtgtatcttcagaggtgaagtgtgtttacattaagcaacagataattgagtcttctttttttaatccattctgccactctatgtcttttgattgagaggttagtctatttacattcaatgttattattgataagtaaggacttactcttattttgctatttgttttcttgttgttttgtggtcttctcattcttatttcctttcatctagtcttccttttagttaacatgattttatctggtggtatgatttaaattcttttttatattatttgtgtatccattgtatggttttcaatttgaggttgccatgaggattgatagagtatcttaaaactcgtaattttaaactaatgacaacttaaaaattgttgcataaaccaaaactaatataaactctacactttaacttcttcctccaactttttaacttgttgtttctctttatgtcttatagtactgtttgtcttgaaaagttgtagttattatttttgattggtttatcatttagtctttctacttaagatgaatagtttacacaccacaattacagtgttataatagtttgtgtttttctgtttgcttactattactagtgagttttgtactttcaggtgattttttcttgttcattaacatcattttctttcatgtcgacaaactgcttatagcatttcttgtaggacaggtctggtgttgatgaaatccctaagcttttgtttgtctgggaaggtctttatttcttcctcatgcttaatgcatattttcactggatatactattctaatgtaatagttattttccttcatcgctttaaacatgctgtgctagcctctactggcctgtcaggtttccactgaaaagtcagctgccagatgtattggagctccactgtaaggtatttttttttttttttttcagttctcttgctggttttagagttctttcattttctctggcctttggaagtttgattgttaaatgccttgagattgtcttctttagatgaagtccacttggtgctttataaccttcttgtacttgaatgttatctttctctatgttttggaagttctctattattatttctttgaataaactttccactcttatctctttctctaccttctctttcagaccaataacttttagatttgccttttcaaggctattttcttgatcttgtgaatgtgcttgattaatttgtttttccattgtctcttctgtgattttcaaataacctgtcatcaaggtcactaattctcttttctgctccacagttctgctattaagacactctgatgcattcttcagtaggtcagttgcatttttcaactctagaatttctgcttgattcttttaaaccatttcaatcactttgtgaaatttatttgatagaattctaaattccttctctgtgttgtcttaaatcgctttgagtttcttcaaaccagctactttgaattttctttgtgaaaggtcatacatctgtatttctccaggacttgtccttagtgtcttatttattttttttggagaagttatgttttcctggatagtcttgatgcttatggaggtttgtcagcatctgggcattgaaaatttggatatttattgtagtcctcacagtctaggcttgttagtacctttctttcttggggaggctttccagctattcgatgcaacttggaccccaagaccaataacagtgattcttgcagactcataggtgtgctgacttggtggccttggataagatcagaagaattatctggttttcagaaagacatttttgttctcttctcttacttttttcccaaaaagaagactccctctctgtgctgatcagcttagaactggaggatgggtgatgcaagacccctgtggccaccatcattaggactgcactgggtcaaacccgaagccagcagagcactgagtctagctcaaggccagctgtgatcactacctggctaccacctaggttcactcaaagccctagggctctacagtcagcaagtgaggaagccagcaagggtaatgtcttgtacttcagggcagtgagtacctccatgacccagaagggttcagacatgttttctaggggccagggactagagtcaaaaaccttagaaatctactgggtacagaggctcatgcctgtaatcctagcactttgggaggctgaggcaggcagatcactttagctcaggagtttgagatcatcctgggcacttgatgaaactcatctgtacttaaaaatacaaaaattagctgggcatgatggcacatgcctgtagtcccagctacagggggctgaggtgggaggatcacttgagcccagcaggtggaggttgcagtgagccaagatcacaccactgcacttcagcctagatgacagaggaagaccctctttcaaaaaagaaagaaaaaaaaaaagaaaaccttagaaatatacctggtgttctattctgcatggctaagatggacctcaaactacaaggcaatgccctttccacttttccctcccctttttacaggcaggggagttctgccaggctaccaccaatattcacttaaagtccaagggctcttcagtgtgcttgtggtgaatgctgccaggccttggagtcattcttcagggcagtgggctcccttctactacaggacaggttcagaaatgtccaagagtctaggcctggatttagccaccacaatagcctgcttggtgctctaccccattgtggctgagctggtttctagggtgtgagacaaagtccccttcattttttcctcgcttttctcaagcaaaaggattctttcaccctagtcacaacagctggaaatgtactaggtctcacctgaagccagcatgtcttagggtgtcaccaaaggccatggcatacgaacaaggtatccctgcaggttattcagggcccaaaggttctttagtcagcaggtgatgaattgtccccagactgggtccctcccttcaaggcagtgggtttccttctggcccaaggtgtatctagaaatgtctaggagctagagcctggaatgtggcctcacaactctgccctgtgccctgtcctattatgactgagctgatatgcaagatttaagacaaagtcctgtttactcttcctgctcctgtcttgaagcagaatgaaggagtcactttcatttctgtgagctgcacagcctgaggttaggggaggggtggtgcaagccctcccttagctgccttggctggtatctccctaggtcaggtgtttccctgttccactggctctaagcccagcctagcactaggaattccataggaatgtcagtccttgtggcttagactgcctttcaactttacttaggatgctggagcattttagactgcagtggtgaggcttgccaaaactcaagttctgatatctgggatgggtaattcctttctggctgctccgaatgctccttccatgggcaggaaccagctgagcaacagtctttggtctttattgtgacagtgcagcaaaacagttcaatggcaagcccgccagtcgctgtgctagtcttcccccaagtgcacagattctctcttcacaccatgaagccactgctagaggatgggggaggggtggtctcagtgattcaaaattttcttttctatcctcttcagtactttctcaacaatatgaagttaaagccaggtactgttattgttcacctgatttttggttctttcaatcgtgctatttgatgtgtggttgttggttaaaatttggtgcttctgttggggagaggggattatccacggaggcttttattcagccatcttgctctgacctaactgaaaaaaataaaataacacaaaaataaaataaaaacatctgtcatatttttgtccttgattctatttatgtgatatattatgtctgttgattggtatatgttgaaccatgtttgcatccctttggtgaatcccacttgatcatggtgagtgatctttttgatgtgtatttgaatttcctttgctagtattttgttgagagtttttgcattggtgttcatcatagctattagcctgtagttttcttttctttgttgttgttgtgtccttgtttttattcgaagtaattttgtctactctggaatcttgctctttctaaacagaaagttagaaacacgtgaacaacttgtagacttattcaagagtagttgggtatttttgaaattgcattgaatctttatatttaggaaagttgacatattatgaatattgagtcttgagatccatgaagataggttagctctctacctttcttagaactttaaaaatttctcttagaaaccattctagtttccagtgtatacatatcatgcatactttatcagatttattcctaagtacctcatatttttaatgttaatataaatgacaaatttttgatttttatattgatttagtttcctgcattatttctaaaatgacttctaagatgtaggaacaatagacaattatgttatctacataaatataaatattttgaattctttatttcattttggatacattttatttctttttaataattcatggcactgtgagattctccagtataatgcagaatgtaactgataaacacataccttgtatctgatcataggggaaatcattaaatatttcaacattaaatatgttaatagctagatgtttttcataaatgttctttagcatgttgatgaaatacctttctgttactagtttgttaaaaattttaatcagaataaatgttcaactgtgttaaatgccttttctgtgactattaataaatatactgtgccttatgccttttttttatttctatcaatatgctatgttctattaatgtattgttagatatgaaaccaagtttgaattttgcgaatatatcccagttaatcataatgtttttatcctttttatttattgttggactcaattttctaaaataagaaaatttaagaaatttttcaactgtgtttctgagagacattgatatgcagatttctctgcttttaacgtctctcaaaaaaatcaaattcgatatgttacattttatttacattgcccttcaagatcgtttctaacttattttttactttttattttacatgtgaatatttggaagtattatttaattttcatatatttgggaatgtatatgatctggtatcagagtaatggtagctttgtagattgaatgagaaagcatttacgcttcctaaattttctggagaagtttgtgtaggatgggttttatttattcattatctggcaaaaatctcccagttaagctatctagtcctggaatttgatttatatgtagggttttaactattttttttttgttcttttaaaagtacagagctattcaagttatcaaatttatttttgagtaagctttggtattttgtgtctttctaggaattcatgcatttcattttacttatttaagtcattggtatatatttatttgtaatattctcttataatactttaacgtttcttcttgcttttcaattttggtaatctgtgactttttattctttccctctctcttttttgtaatttatcagtcaacataaagccttatcaattttgttgatttttccaaagaaccacatttgatttctgtgacttcttcgttgtctttctttctttattttttactgtttttcattccaatatttatttatggatatttattattttcttccttcttttggctttctgtttaatttactcttcttttttagcttattgaaatgtaacataagttttacatctttcagcctaacatatgttttaaaggtatgaattttttctgaaataatgctttactgcatctcattgaatttgatgttatactttcccttataaactcattcatggtagtttcttaatttgcctgtaatttatttcttctacacttgtctatttagaagagtggtgttgtttaattttcacgtttttggagctcccctattttatttattttttaagtatttctaatttaattatgtttttagtcagagaacatatttcacgtgattacaaatctttcaattttactggcatccatgttacttttcctggatcatgttgcagggatttttataaaacatggatatgtactctgctattttggaatcaatagtatttttcaaatgtcaagtatgtcaaactgactgatagttttgttcaggttttctatatttctattgactattcagttagtttttctatcaattattatgagagtaatacgtaaatctccaactctcatttaaaaattttttttctttgaattttgtcttattttgtttcattatatattgtgtttctgttgttaggtacttatatatttataactgttatgtattcaaaatatattgacatttgtgtcatcatgaaatgtcgttctttttctgtataatatttcttggcttaaaatctattttctatgatgtcaatattgcttttccatctctcttatggttgctattttcttggcatattattttctaatcttttagcttcaatctgttttccaatggtaaatcaaatgcacatttgttccagtcagaataaacttgggttatgtgtgtttttttaaattcagactgacaatatctaccatttgattaaggtgtttcagtcaatcacatttgaaataattatggatatgcttagatgtatgcctgcaattctgctattttttctagatgttttatgtctttttaattttctatttctttttactgcctaagttatattaaagagatagcttcaatgtagtgctttaatttgtctgttgattttttaactatatattttgatttttgaaaaagattgctcttgggaatcacatatgcatctttaagtgatcataatccacttcaattttatactgatttaattttggaattatataaatattttgctgcattgcagtatagatctatttcaaactattgtttttcatattacatgcatgtataaactcaacagtccaggattattcatgttttaagcaatctcattctttaagttattaaaacagaaaagttccttttttaataaaaataagtaacagcttaattatccttttctttcctgtgaatacaagttactgcctggcattagttttcgtttctcacactgtcggacttcgttaagtatttcatgtggggaatattttgtagctgtgaattctctcacttcttgtttatctggtaaagtattttgttgttgcttctgaaggatagttttattagaaattgaaatctttgttgaccttttttgtttgtatcattcaacactttaaatgtcactccagtcttctggcattcattttctgatataaagttagctgttacacatattgatactttcctatatttgataaatgtttttttgctttcagtattttcttttatctttgtcttccagaagtttaatattcctagctgtacatctctttgtgtttattccacttgagacttcttgaatttcttgaatctccagattaatgttgttccttgagtttttaaagttgtcaattatttctttgaataataatgttattctccctcttctctctcctttctgccttagactatcaatacacatgttgatatgcttaacacttttccaaaggtctctaaacctgtccatttcttcaatccattattcattctgcctttcagattggataatttctattaatctatcttttagtttactaattatttttcctggctgttttctattcttttctactctaaaagtttcatttgtttcttatttttaaatttctgtttctctattgaagttgtctatttgttgagtcattgctataataaattatttgaacatatttagaaaacttctgtaagtttttgtttgctaaacaaaacttgttttttcatccagagtcagtttctatcaactgcttcttttttcccccagaaatgaatctcactttcttcttcgttttcttgtttgatactctttcgttgaaaattggacattttagataataaacgttaccaattctggatttttgtctgaaaatttttaattgtgtcttattgtaatatgcctgagcagtagctgtaggatctgtctcccttgtggtgtgcagccactgatgtctatgtattttaattcttatttttattttttgcttgacttccttgggcccagttctctattttaatggctagccaatgatttggaaggaggttctgtgaagacatcttacacccataggattccactatctactgatcaatctgttcaggttgaggtgtgtattcaaagtgcagccagttctcaagttctacttggcttcctccccactgtgatttgggggctcttttctctgcatgtgcatagcttcctactcagccaggtgtatgtggaaaactcatttaggccttatttgactttctcatttctagggtcaacctgttaaatttgtcagtgtctgacaatttccccagtaagcatcacaactgcactgtaccaaactgtgaattgtggccatttgtaaactaccaaatttgttatttcagttgtcaaagccacaagtttatgctactcactcctatttgattccatgccatcagatatcaaagttgttgggtttcgtgtcatgttcatgtgaacaaagtaagtaatttcatcgaccgctgagagtaggggtggaaaatgggaataaaatgaggtagtaagaccataaactcctactgttcttacccaaagttatagcagtttttgaaagacaacacttctcaatttatagtctgcattaggttgactatgaagttcccaaatcattgttcgtgactgtttatttttcagctttatatttgttttatgtgattaggatttctttttcgtatcattcacttcatgacactggtagataagaaatagcaaaaaaaaattaaacttttaacttaaggatattaaaattaaggaactgtttaaaaatgcatggaactttttttgagaaactaaaaagattatatatagtcacgagggaggcactaactcggcctgaagaggaaaggaaagggaactgttatattaattattaaacagtggttatatgtacaagaatgcctgagaggagatgtatcctttggcaaagggtcctgttccaaccttagcagtctctgcagggacagagttagaaaatatacagcatcatctcactctccttcttccctttgcctctgagtagtttctctgatagaaggacttcaacaggaagctacagggcaaggacatttcttcgtgagctgcataaaagtgagaatcccagacagagaacagagggtaggaggattaaaattatagttagtgtggggaggggtagggaactgtagatacacagcatacttcgtaagtaccatcatatttgattgttttcactgctggattataatcgatttgctggaaatttttattcagaaaaaaggcataaaataagtgactatgatatttattctattatacaccatagtaaatttatatttaaaagcattgaagaatgtattttgcttttactactgtgatacccttaatatgttgaataagccaagtgtggtggtacatgcttatagtcccagccacttaaggaggctgaggtagtagaattgctggagtccaagagtttcagtttagtctgggcaacacggagagactccgttttttaaatttactttaatttaattttttttgagtcagggtctcactctgtcacccagtctggagtgcagtggaatgatcttggctcaccacacccttgacctcctgggttcaaacaatcctcctacctcagcctcctccatagctgggactacaggcatttgccaccatgtacagctattttttgtggagactgggtctccccatgttgtccaggctgatctcgaactcctgggttcaaacggttcatctgcctcggcctcccaaagtgctgggattgcaggtgtgagccaccacacccggacaagaccctgtctttaaaacaaacaaacaaaaaaatctgaagcacatgtgagagcataatgttcattgtagtaactttacagcaaataaaattaatgcctaatattgtattttgtaatcaccttgtcaacctttgtgctttctaagagtttttgaaaacctttatctccatagtaacagctggaagatttttctaatgtagtgaaatatacaggatcttttacacattcttcatgcacagaaaaaaagtatttcatttaaaaatgtctttagatctagtagaatccttgactactatatgaatgctctaaaatgtactcacttgtgttactaaacatataattttattaaaatgctttctctaaatttctcttcataatacattacatttcaagtaaaaggagagagaattcagctattctcctttgtcacttttcattaattctgtaatatgttagactatatattagaaaagaatgttccaccttcagttttctatgtgaaatcagtgtgatattaggaagtagacagtaggctagcagttggaaaattagagtcatagttatgttccctactatgcctatgacgttaaaaagttctggtgtatgtgctttactatgtatatctgacttattttctatattaacttgaatacaaagccaagatttctaactgattaaatagaagtccaagtaggtgaatttttcaggacgtaagagcaatagagtcgtgggcagtttcaggtagccatttagagtctggactctataggtgtagcatttaccttactagcagttgcacatggagacatgaatatcttgcagcagatgtgattcagaaatgcaagcaataatttagttgcagagttcaattcttcggtggttaaagaaatcggtaataagatgaaagccaagtgtacaggaaaaaaaacactagccaggattactgaggttaccaaggctgcttcttagacatataagacaaaaagtgccccacttactaattgaagaagaaggagaagagcatctgttaaaatccaagagcaatattagaattcaataatagaaacattgcaaagtttatggtgagtctccctttcctgctagagtgcaattcaaatcaatgttttctgcatatagaatgcatatgaaagacttgggtgaagttcgttttaagcctgttgtggtgagactagaaacgtagggtattgatggctcaaaatttcctgagtttagggtacctttattttgaaatttggaacaagtaaaatatgtgtcttccaacaaaacatagaatgtgtgccttgaactgatgtatttatcaccaggaatgcccttagagggcaatgataaattgcaataacacttttgaaaattcaaaagaaataatatgaatttaataatttaagttttaattatgatcaggtgaagtacagagacagaatgcaggaagatacattttagctatactctttcatattctaatgaattgatgaatacagatattttgggaagcacagatatcatcatttacatttaattaatctgcttatgtttataaaaacatatgttattcaaaatacacatacatggctggtgagtgtgaattgttatataacttttggagggtagttttgtgctgagtatcagattttaaattgcacacaccattttttccaactcttctttttagaagaagttttttaacaaaatattacatgtaatagaaaaatgaagacaacataattgtcttcattataggaacgataacataaatttgtacaatcactccatagattataccaaaatccttgagtaggtctatatgtgtaaaaataaaagttgtaaaataaaacactcacacattcacaaaataattccatctgtttatgtcttgttatgcctatgaacacaagttttgattcaacttttagaatgatgtctatgagattgtacaccctgagtggtcctaaaacagacactggagctggaggagagaaagaactaagcttccatattttattttgtgtatttttatatgtttgacttatttttaatcaacatttatttagatattatttaatgacttaagaaacaattgaaaataataacatattacatacaatttattacaaaggaataagaaaaattagatgggatatatattttttgtggcattgtgattcttacagtttcaagtaaattgtaactcaattatattttgagaaaatgtgaacatatttctgaaacatagaaaagcattcaatattaagcttgaaatagtttctttctagataagaaggcctacaattcctacagaaggagaattataccatttacagtagcaaggaatcaagagatcattttattttaccatctaaggaaaatttctgggttgctaattttactttatctaaaaaaaagaaattggatatctaatggtagatttaattggagtatgttgtgacaaattgacgtatagtagaatgctatgataacatttgtagttatttttaactactcaatgagcaatgacctatgttgaaatttgcattttaattatacaatcatacccacagaagcatgagtaaattttaattatagtttgaacaatatgcacatttagaagaatggctaaaatggatgtgctttatatgtatttgtgtcaattattgaaaatgaaatttcaaaaaataaaatttatttggatttcttacattccataaaataattcattttgttccattagcaaaaccatgaatgcattatacataccaatgcatatgttaaatatatcaaaatattaattattacttaatacaattattttaaacatttctgattatgtaatgttttaagataatcaggggtttcaagaagtagttttttcttttttttttttttttgagacggagtctcactctgtcgcccaggctggagtacagtggtgcgacctcggctcactccaagctctgcctcctgggttcaagccattctcctgcctcagcctcccgagtagctaggactacccgcgcctgacaccatgcccagctaattttttgtttgtttgtttgtttttgtatttttagtagagacggggtttcaccagtttagccaggatggtctcgatctcttgacctcatgatctgcctgcctcggcctcccaaagtgctgggattacaggcatgagccaccgtgcttccttagaaaattagaagttaatgaatattgaatagttgctgatatttcttagaagaaaaaaagtatagcagctgaatggaactgtggctggaataagaaacatggaagcaaatacttatcagcttattttgacatttagtttaattaaagcatcttaggatttccatggggagaaaactattctgctgtactttctataaagaccttgaaaaagcaggatgaggaggaagcataaccgaatacagagacagtcgacaacatgtttctactaggtgaccagggacttgttggaagtagagggataagaaatcatcatgccataggaactctacaaaagcttccagtcactcttagaataatgttcaaagcctttacaagaaagcatcagagtgcatcaagagacagaaatcacaccagttatttaactagagagaacttaatgtaaagaattttacctagatatataacatgttaaatacgtaactgaaaaggtgaaaagacacagctgacttgtgtgccacaaaaatagcagctgtaggaaacagacaccacatctggggctgcaaagatacaggaaagaggcaacgcatttgtcagtgttctccagagaaacagaaccatggcacatactgatcaatcaatcacttgatccagacaaattttaagaaattggcttatgtgagtattgagcaagtgtgaaacctgtaaaacaggccagcagacagaaagtggaggcagaattcctgtattaaggcttgagacacaatttcttcttctccaggagttctcagtttttgctcttacaacctttatgtggtttgaagagccctgccacattattaagagtaacttgctttacttagtcaactgattgtaaatgttaatcacatatacaaaatagtttcacagcaacatctgctctacggtttgaccaaacagctagcccagatgacatataaaattaactgttacagtaagaataattaaaagaataattaaaacataaaaccttagataaagtgttttaaggaaatgagattcgggcttctaagaaagagaagtcggtacttagctagtgctggtgtccctgagctcagagaagggactttatgggtcagggtcatagacttgtgtaaagggccactgacactatccctgagatgagcatacaatgaactgggttctgaaaatgtggaaaaaagcaagaacaggattcagctgctgctacagaaaggaattgccactgacaaggtgaaaaagccttgctggagtgatgctcacaggaagcacgagcaggcaggaagccacaggcaggcaataggacatggatgagaacaaccaagtcctttttcactctttcagtctctctcttgagccctccccctcagcttctcagagtgcacacagccaaagccaatcaacaagatgtcaccagtgtagtggacctgtgtttcatgtgcagaatgattagataattgtgcctttctgtggaacatattacagaaaatgcaggagcattaacagaccagaggcaggattgtggcagatttactccgtaaggctttaaataccctgccttctgcatatcactcagcattagtgcttaactattctcttcctccgtcacgcaagccccagctgtagtgatctacttgctacccatctacacaacagctgcattcccaactcagggatgtggcatttgcttttgcctcagctcataaagcttttctatcagacaggaacttgattcagtcacttgcttcatttgtttctcagcaaatgtcacccctaagctacatttttccagatactgtatctgagatatcatctctattgtcctgtgattgtttatctcactcatcctgttttactactccgcataacacttatcactgcctgaaaccacagtatacatccatttactcctttattgtttacttgacctgcaagaatacaagcttggaagggaaggaacctgctaatttatgttcactgaactttgacctataactgtgctttgcattttttcaatcctcagttaatttgttcaatgagcaaatgaatcttggcatgcataaaaggttaatatgaccacaccaattaagatcaagtaagcatttcacacacacacacacacacacacacacacacacacataaataacgaaaaacaagaaaaataataaaaatgtgctccactgggaaagctaagctgagctaagaaaatataaggcctgtggaaacagaaatcttgttgccctttcttcattgtactcttgaagcagaatgagccacagacaaaactcctcagacaccaagttaaagaaggaaggggtgtattcggcctggggcatcggcaagactcctgtctcaagagccgagctccccgagtgagcaatccctgtcccttttaagggctcacaactctaaggggttcccgtgagagggtcgtgatcgattgagcaagaagtgggtacatgactgggggctgcatgcaccagtaattagatcggaacaaaacaggatagggattttcacagtgcttttctatacaatgtctgtaatttatagataccataaccgattaggtcaggggttgatctttaactaccaggcccagggtgtggcaccgggctgtctgcttgtggatttcatttctgccttttagtttttactttttctttctttggaggcagaaattgggcataagacaatatgaggggtggtctcctcccttactctcagtatatggaagaaagtctggcagacagcaacttctcaattatgaattaatttaatttataaaaatgaaagtgaaagacattacttatcttcgcctaagttgttatgatgtttgcattaaactacttataattttgtgatttccacaaagctgcaaattacaagtaactggaatatagtcaaaagagaaacaaccagtaccactaccacagcaatgacaaaaacttagaaatacctaaatatacctgtaactgttcctttgttctcccctaatattttttctgtgtatttcattttcaccaagcaattttactttctacgtttttatttcatactgaaagtattttcttactgttgcatgcataatcactattttggtatctacatactattcacattataattctaccatatactacatttatctctatggtaaaatgtttacttcaagaaaaaatatttgactagaagcctgattagttttctctcactgctataataaattaccacaaaccaagaggcttaaaacagcacacattacataagctcacagttctcaaggccaagattcctgaaaaactaagcttgtttcacaaggctgcaatcaagttgtttgtcagactgtattctcatctggaggctccgctgtggaagaatttgcatccttgcccattaggtcgttggcaaaattcagtttcttgtagctgtatgactgatggcccagcttcttactggttgtcagttggagacctctaaattttacagaccaccctcaattctctgtcatggggccctgtatatatagagttcacaatatggctgtttgcttttcaaggccagcaggaaatgcattttagagtgtgctagcaagatggaattatatatgtgtatatgtgtgtgtgtgtgtgtgtatatatatatatgtctatgtgtgtgtgtgtaattaaatgatcaagtgacattgatcactgcccaaggacaatcactataaacatgcattttccctagtctgtcttgtgcatatggctgtttatttttctgtttcctgctatcatttttataaaacaatgttttgttctctataatttaagctttatattatgtgcaaattttgattttctatgatagagcatcaaagtggttctgctattattagagcactatgctgaatatcatggcagatgaaaatgttctacttctcagataagaatttaagattcactctaggaatagattttattttaagtatgatgaatattttaatttttatgatagtaatagcaaaattagattcagaaagggtgcttacacccatctggagtacctatatatgcttaagtacctatttatctgctttctgttcagtgttgggtgctcttattttaatttttaaatattttcccaaagtttttatcatctctgggccattataagctacatggctcacaggggccgggcaaggtggctcacgcctgtaatcccagctctttgggaggccgaggcgggcagatcacgaggtcaggagaccgagaccatcccggctaacacggtgaaactctgtatctactaaaagtataaaaaattagctgggcgtggtggcgggcgcctgtagtcccagctactgaggaggctgaagcaggagaatggcatgaacccgggaggcggaggttgcagtgagccgagatcgtgccactgcactgcagcctgggcgacagagcgagactccgtctcgaaaaaaaaaaaaaaaaaaagaaagatacatggttcccaggaatcagagtcagttgccttttacccatgctactaagactcctattatctttttcctttcatagactcctgatttaacccctttctatttgaaatatattggcttctactcttcagcctctcttccaggcatgtctgcagaaaaaaaaaaaaaaagcaagcatgattctattagttttgcattgcagccatatcaaattgacacaaattcagcagcttaaacagcacagatttctcaccttgtgttcctgtaggtctgaagatgcacatgagtctcattgggctaatccaggtgtgggcaggctgtgctcctttccaggggatctaagggagacttgtttcctagcttcctatgactggcatcctgctgttcttgtggttgacgatctgaggtcccgatttcctttctggctgtcatctgggggccattccaagactctccaggttcactgcatcccttgtctctctccatctttaaaactagtgacgtggggtgagtccgtctcatatttttaatctctgctcatttttctgtcacgtctctgatggattcttctgctttcctctcccgctgtgaagggtctatgtgattggatggatcctacctgaaattcagggtcatgtcagcagcacaaactccttcatcttaatcacacttgaaaagtccctttggcacctgtaggaacacagtcccatgttctggggtttgggagacaggcatgtgtcaggcgtactattctattgctgtgatgtaggagtgaagagcacatacagaattcagagctagacatagctccagatatttgctggggtgcctcagagagagtagctaatttttctgcacttccacgttatcatctatagaatgggcataatagttccagttaagagaggtaaacaatgaacaaatacatatttacaggagaagtaacaggttgttccatgtggaggagactgggtagcaacttttgcttgtatattaaataaaagtctcactcaaggagttatcttttaaactgacttctagatagaagtcaccagcttgggaaagaagtataagaagggtggagcaaccctgttcagaggtgaatgatcttggcctttatctagaaataaataaagtgattgtggctagagaggcatggatgatagaaagcaggatctctggtgagcttggagacataggctattgccaggccatgcagaatttgccatcagagcaagggggttggaggcaattaactgaaacagaaacacatatagttatgcagggctgtaaccataaagagataacttttttttttttttttgagatgtggttagagttttacattctataccattttcttttggtggagtatagtcataattttatatgttttttactctatttttctcagatctttcaagtaaatatagcattttttgagatgccacactggtcctaaaactgaacacaggctgtgactcagaccatgcctccagggagatagttcacactttcataggcaagataaacagattattcccacatggctgggctgtcactaccccaagatacggccttacaagcacaaagtaggtgattcatgaagtaacatcacaagtcctccaacaacaggaagaggtgtagaagcaggggaagaaagttcttgttatttccttttaatattttgttcagacaaatttaaacagactttgctaatgtttgatagccattattagcttagagttaataaaaagcaaagatatcaattgctttctagttatttttagagtagagcctcgataatacaaacaatgaaataagtaagcactaatacaaacttaggtgtttgtccaaaagaaactattgatttgtaattcctcagcctgagacagccaacagacaactgccaagcctcattaatgcattatcctgacaagtctatatgagccactgatttgtaggtaattcagtacacatagatagcttttattgatttagaaatcaacttggaaatgaaatttagcatcatgataacctataaatatttgattttattttagttgtataaaactcttagaaataattagtcaataaaataacttttagaaataattaatgacttgcactaaatgaagagtcatatatctctgatttcatacccagatgctttctgtcttctttcctctgctccagccttgctcctatatgggctaggtgtcaaatgcactgagggttctcattctctgagactttgtgctcaccctctatgccagcagtgctcttccacctgatatattcatgctaattctccaacttgcctcaagattttcctcataggtattgcatctgccccaatctctctgcttaccctattagcaactaccacatcccatatgctgatctactcttctctcctgtagaacattaaaaactgccagtggaagaaagtttgtcaatgtggttcaccagggtatcctacgtagttaaaatagtgcttggaaaataataagtgtttagtaaacacttgctgaatgtaagaataaatagtgttccataaatgatgctaataccatttatattacttccaaacacctcaacttgtatagaaacagttaatgtttaataacatactttgataataatctgtaggtttttttccttaagtttaattgttatagaaaacttaatttagggaaaatagtgtttgaatgtatgatatgtattttgtccttgggaagctcaccattaaagtttatgtcttaaggtagtcgtttagttagggtaaactataagttctctttatttgtaaattaaccataatcaatttacatttaaaattatattttaccaatgacatttccatatttctgttgaaattgtgaatctgaccattggtaataaagaatatatatgtaaatattaaattaccgataatcatacagatagttaatagtgtattacagatgagattataataaaaaaggtcggtggtaacattgttgctttcttgtaatttcaaagacattagcagatgaaatttctaagaacataataaaatagaaatctttaaatagttaggagttttgaagatttcagttacatcttctcaaaggtaaatatgtctccttataatgaattctttcaagatgaattaccgatgttttcggtgaaaatgttttctgaaattccatttataagtgtttttaaaaatttatttttaatgcacagaaatgcgactgacttttatgtattgattttgtatcctgaaacttcactgaatttgttagtctaacaatttttggttttgttttttgtgtgtggaatctttaggattttgtacatgtaagatcatcttttctatgaagagataattttagtctctcctttacaacttagacacatttattctttgtgatcaattgttctgacaaggatttccagtattatttttaaaagaagtggcaaaagtgggccaccttgtcttgtttttgatctgagaggaaaaaatttcagttttcaccactaagtgtgatggtagctgtggggttgttatacatggcctttgctttgttgaaaaaatttcctctttggcttctatgtccagttttttgattgtctttgtcataaaagggtgttgaatttttcaaatgtaatttttcttcaatttattttcttgtagaatatagttgatttatataaaaacatctgagtatcttgtagcaatgaagttctagaataggaagaacctatttaattcaatgatcaagaaattcaatttccagattccatgtccctgtatgtgcccatttctaccccacaaaaacattttcagaatgttcacaaactattattcttcacatcaattttaacataaaatatatcatgactttttgaaaatttctttctctatatcatgaagtatttgaaaatatttgtttttatatattgattttaaaatcaatgtttttattatgaaaagttgaaaaatacatacaaataaaataaagtgttggtctcataatatcaacatacagaactagtaatcttttaaaaatcatggatttgttttgtttatatcatatgtaatttttgttgagatcatacttttgtttttattatctctttttttaaactcttaaaattatactcaattactttattgtgagatttttcccatattcttttgaaatatgattttcagtggttatgttaagctatctggaagtaatcctctattaatgtaaattcattttttctatattctccctcttacaaatactaattcaataaacaggcttttgtgtttggtggtatggatttctaataatttccttagaaattctctaacagtggaattcttgagccagagatgattttctcatggctatggttatacacatagtcatatatcacaaagctcctaaagaaatataaaaaatgtttctttatagctatgttagagtaaccactactgacatttaattctaatgcctctcactagaattcatgcatttactctcctttggtgagataatttagcttttgacctctgaaagaaaaacaaaaaaaaaaattatattttttttcaacaatagcaagtagctttttataattttgtttggcagctctaaaggagagttttatctgctcatatgtcaagaatttctggttgttattgggtcactaaaatgaccaaaatggccctggatgtcattttaagtcagaagaggcataaatggaatttggtacttgaaattctcgagagaatgaagccaattccagctaagaaagttaccttggtagtactgctactagaaatataatggttttgatttaaagtagtctgaggcagtattgacatctctttattgagctatagcactctagccttgaaaaagtcatacacgttttgtgaactaacctccattccttaacatcaccgtctttcaagtttacagtacttagttcatgcattgcactttcacaactaactccattatttgtaggttagttttttctatttctgaaaaatctatactttgaaagctttcttgaaatgacaagaagtcaagttccaacggcattgaggttcatactgcaagacacaaggaaagtgactctgtcttccacacggagacgttcatagagtcaaagaaatgtcccttcctctacaccttctcttctgtggtccaaagtactcaatttattttcctgttttccttggcacttgctttccaaaagcttcagcatttcttttgctcttccctaatcatacattaactggtcaatttctctattataatatcactacagattaatgataataaccaagggccttgtctaagctcttcacatatattatctcatttaatcccatcacatgtatacactaagttcaatgacctcaacttacaggtaagaccctacagcacatgaaggtgaagaaactgagcagaactacatgggtagttgttgacatgattagctgctgggctttatcaatacatcctttcctaaatttttctgcaggcattgccccagatgtggcagatcaatgcagatacaagaggtttcccacttccctttttgtaagcactgtatttaatgaacgttgtgaaggatgctgtcagcagttctgatgactatgtcaagatgaagtcatgggtatactgatcaacttggtttaaccatcccataacacatgcatatagcaaaacaccctgtagaacaccataaatatatacaatttttgtcaactaaaaatcaataaataaggaccaaaaaagaacaaatcatttgcttgttttgatcattgtcagttacttttgtttctgaatcatagattatcatagataatcccactcacacttgtgaagtcaacttgctaaaagtaaatgaatactttaaatactcttaaatcccatcactttgtttcagtatgacaaaaagtattcaattcttgcttttaaactccaattcattagcgaatattcccaactttgtagcaaggcagttttgatagaatattttctgttttcatctaaatttgtcataaaattcttaaaaatgacaagagttttctgatatatgtagatatgatacaggcagttggaatagagataagagtacatatttattgaattatttttaaaactccttttggaagatggacaccccatgtgtgctttccttcccagtgagactatggtggtggatttttttacacagccaaaagatacacacatggcttcaaaccgattatataagttgttcaaagttttttctgatatgagaattcaaacccaggtttgcctggtctgccagcatatgcttttttgtaatattcttctagatccgtgggcttcctacatacattcttgggcattactatgtttatgagaatatatgtgctgaacttcctttatataacactcgttttactatgaatttcttcttggaatctatcaaaatatttcaaaaggatgatgagaatatttgttgcaggcagttactgaccactcattgaagtagacaacaaaggcagaagtgcaagtggagattccatagttcaatttgagaaactagatacaatgtgttattggactgtcccaagaccagctcggttgaggagaccctaacccagtagcactagatgaaataaagacacacacagaaatatagcatgtggagtgggaaatcaggggactcacagccttcagagctgagatccccaaacagagtttgactcacatatttattgacagcaagccagtgataagcattatttctgtagattatagattaactaaaagcactccttacaggaaacaaaggaatgggccaaacaaagggattgcctctggctagttacctgcagcaggaacatgtccttaaggcacagatggctcatgctattgtttgtggcttaggaatgcctttaagcggttttctgccttgggtgggccaggtgttccttgccctcattctgataaacccacaaccttcagcgtgggtgtcatggccatcaggaacatgtcagtgcagcagagattttgtttatggccagttttggggccagtttttggccagatttgggagcctgttccaaacaggactggaaagggcaaattcttttaggttattatttatgttttatctttttgagtcattgtggaaaaaatatatatatattaaggtctcatcttatatgtcattacaatccctatttatttttcactattgatgttgatgtttttatttgtgtattgattttgtcgactgcacagcttattattttaaagtggctttcttagcatcatttaatcctttttgtctgacttctactttttctgatttaaacacctctcttcattttgttccatttccaggcatgactgccattgctcatctttgtattttaaactttcctgagtcactttgttttctgtgattttttgtaggtattacaaagttgagttttgtttaatgactaaaactcaagtttatattttaacagataaatttacttttattctgaatcatagattatcatagataataaaaaaccatcatgaatggattaaagctgctataaacaaggcttgcaggagtgggtcctctcttgctcatctgtcatgtgaggacagagtgttccttttctatggaggacccagctttcacaacagcattttggaagcagacaaagtgggcccagctttccagagccttgatgataaactttccagcctttagaactgtgagggataaatttttgttctttataaattccccagtgttaggcattctgttatggcaacacaaaacagacacaacatcaattgtacttctagtcaactggctataaaccagggttcccatgaccccaccttcaggtttgattaatttgctagagcagctcccagaatgcaggaaacattttacttctaattatcagtttattataaagaatgttacaaagtccgcagatgaatagcagatggaagaaatacatggagcaaggcatgagagaagaatggagcttccatgtctccttcaggaacatggggtgctaccctccaggaacacgttcagctatctggaagcctttatgaagcctgttcttttgagttcttatggagactgcattacataggcatgattgattacattattggccattaatgatcaacccaaccttcagcccctctctcctccccaggattaaagcatgggctgaaagtcctaaccttctaatcaagccttgttctttctggtaaccagccccatcctgaagctgcctaggggctaccagccaccagtcatctcatggaaacaaagatcaaatatgtatttcacagtatcactgtattaaaaaagttcatattttctttcttccagaacattactatcttatcatgttacattttgctctttggattaatgaagctacttttttttttcttttatgagatttttgtattgacctggctgactaaaagagtctgtccttttttgaaatttaataacttgattgatttaagcctcggaattgatttttccaatttcactattcttgaaacaagatgtgttcatttaattggtagatgcaaatcatcttatagtttgtgcatttttttctgtaattgtttgtttatatttgtttcctgttaattgttctgatcttatttagggtcactaatgatgtacatggagggtctcctttgcttctcttccagaactgtcatgttctagtcaatctttttacatttatcttttacttccattttttttctcattttctcagtcctgttgttcgttctttgagtgttcatcagaatctattcttgttgtacctttcaatttcaccttcctttatgtgaatttataaacttttgtttctgcttctcttctaaaactgaataagctatatttcttttcctttttgctttactctcttacttgtggtctttaataataacaagtaaatcaaaatatatgtttatttttgcttgtttactttattttgaagtaaaacttagaatgacatgaacaaatattgaggtatctttgttgtgttttcacaaattcaggtgcttgtgtaacacagttacctatcaacatgtagaatattaccagaatattcctgcataccctctttctagtgaattcgtctcttgctcccagtggtaatccatggtctgatttttttccccacagaaagacaagtactacatgatctcatttatatgtggaagctaaaaaccttgaaatcatagaagcagagagtagaatagtagttgccagagcctgaggggaaggcagaaatggtgagatgttgatcaaagggtataagctttcagttgtaagataatttctggggatctaatgcacagcatgaggactatacttaacaataccgtgttgctcacttgtggtatatcttctttgtttcattattctacagcagagatttttttcaaatttctttaatgtatacaattttttatcactattagattttttattgcaatattttctgttgaatatttttttgttttgaaataatattttctgttcgtcatctcctttatgttgtagtaagtttacatagagactatgcttgttccttcaaatgagatgatttttttccactcaaatctatagagaaagagataactcaatttagatattaggataattctctgaaacagtatatcacactatgtaatctaacaaatccttactgtccatactcagttaattgatacagaattctgttaagatacatggtgtttgctaatcttgtatgcttctcatgtctggaggttatttaagtgtgtcctcaatgatattgactaattttagaacctgagtggtcaaatccttaaaattaaaactggagcttctgttcataaaagattcttttgctctcctcttgttacacctctgtaagatttacatatagcatttattttagtgacttcagagtcatattggttgtgtcattacctctgttcatgtaaactataaattccttattttctctactttttaaaatgctgtatggtagttgatacatcttataacccaaaactatagggacgaccaattgtctgatgaatttagctactgtgtcaaaagaaatgcataacagtgctgcttcgatattataaatacatgtggcattagtacctaggccagggcctatgcaatgatagccatttgatgtttttgttcaataggtaaatcagtggattatttttaacatctggatagtttttcaattactttcaagattaaatttctattttgcatgttgttggtaaaaaattacaggtgataaaaggtaagtaggaatttatggaaaacctaaattatttatataatcttcatatttacccaagatcataaaatgaggcttgaaatattaatttgtgtctatatctgtatttttctattattgagtgataaagaaagaatatcatgcatttactctgctttcaaagagagaaagagaaagaaagagagaaaaaggtaggcttaccttagtttaaggtttttaagaaaatagaatgcagcaatcatatgccttgagctcttaaatcctaataaatgccatgtgtgataaaggcagcctaataattaatgccaagggttttggggttatgccaaccaaatcttttctccacagttcttcagttcttactggccaaatgtcctcagtagttgagctatactttgtcttttaattgcttcatctataagatgagttgttttaaaacataatgtgacttaacaggtgtgaatagcacagaatttattttatatataaatactacagaaacacaaagcacctcctctttatttatacaaccatatctacagccaaagtaatctcaatgtcagtcacctgcacctagacctgcaggtaatgtgatgagaactgatggaatttttttacttgagagttataccccaagaagacagatgaagaacagtgaattttctttatttatgtgcaagtgaaggacaactgtcaaacagcactctactcctgaaaggagagagataacttgtcctttggagactggatggaaaggatcctaggctctctgcctaaccttttggaatgccaaagactctccaaaagtcagatacatccgaaacgtctctgggttttatgaactagagatacctccaagatttctcctttgtgagatgtacatatccagggagaaagcttcctagttttccaggagacctcagggataaacctaggaatttagtctgggctgtaacctcttggccctcttacggggataggagaagtgttgttatcttttctgctcagatgagagcaattcactagaaaaatatctccagatgtaattcttatggtatgtaaaaagaaaaagcaatgtttccagtagaagtgaaggcaaatattcttgtctttttctgtatacatttcctgtctcaggaagctggggctttgtataagcacacacagaaatctagagaagtttcatttcctcacagcaccataaatgggaacaaatatttataatgtaaatgcaacaatttttggaacaccatttcttcataggcaccaattgttatcctgattatattacattatattatagagacatgaatctagtttaaccagaacccattttgtgtgcttgcctgagcaacattctttttatttttttggaatagtttttaacacttgattgacctcatcaaattaacagtgaatgactctgaatcgcaaaaccaaaggacttattcaagggggtgatcacatgttatataggcaaattcgagaaggataagtaaagagaagccccatgggtgagaacttttatatttttaaataatccattgataggacaactgttgtattctgcttcctttattacttctttaagtgtgatttaattgaccatattgtgtaattcatcctccttgatacataaagagaaatgtgatttgttctacagaaaagcacagtgtgaatctatggtttaagagacctattcatcccatttgcagtttaatggactgactctacgctctgtagtgcagacactgcagaaactttctatactgctggaatacccttcttacccatttttgatgattagacactaaatcaatgctcacgtctgctatattttactagtctagtttttagagttatttgaagcattaaagtaactcagagtatatgactatgttaagcgatttgtcattaggaaatacttcaaaatgaggtcacttgaaataactactgtgctgtttaggaaacacatttttaagcactagttaactttcacaaacataggatatggcagtcactaaagggcaaaacaggtcaaaatacagaagtgtcaagtacattatatttatatttatagttacattctagccttaaaggatgggtaaaagcttaggaattggggtaatatatgataaaatgataaatatcatggcatgtattttattttaatagtctttttaattttatttatttatttatttatttatttatttatttatttatttgagagagggtctcactctgttgtccaggttggagtgcagtgttgcaatctcggctcactgcaacctctgcctcctgggtttaaatgaaccgtatgtctcagaatcctgagtagttgggaccacaggcatgcaccaccacacccagctaatttttgtattttagtggagacagggttttgccatgttggccaggctggcctggaactcctggcctcaagtgatccacccaccttggcctcccaaagtgctgagattacaggcatgagccaccacacccagccctatttttataatctcttattaggttaagaaaaatatattttatatgctattactattatgaaataataaataagtaaaacaagtaaatcatgtatagctgtaaatcaaatattttaaaactagtaagatgcatgcctttcccaaaccaaaattctgaagactgttatattcaaaaagaaaatgtgattatgtggcaggggaaggtttaggctatcagtgtctatttgcaggcccaagatgtcagctgtgccataattaataaaggtcctttgtctctgattcaagaataccgtgtcttctaccagtacctataaacctgtgttaagctaacatattcacttgcaaaacctcagacctttcatggcctataacaatttgtcagtgcggctgaaatgctgatggagacatagctttgcagtagaaataaagatgagggcctcattaatcattaattggatttgagagcattcatgggcattagtaataaatatattgatcaaattgttccttcaaccaggctataaagctgtcttccatttcattgcctattaatgtggagtaatttgagaaaagggtataggaagagaattgaaaagtaagttcaaaaacagctttctgaacaatgtcttctgtgtttctaatggttcttcacgtggggccatcttgctccccagtcttgcagtcagtctcaggcctggtactctgaaattgctattaagagatttatctcttttcagacaacaggtacatttatgtttctgccctgggcattaaagcaggaaaattcatagccactctgggtaaaaaccagtggaatagttagaactttacctggctcaccagagagatgagagaacaggtgcataaagcttcctaaagatggataacaagggctgtgctcagaaaggaaaagaaatatgctctgcttactagcatgaagtgtctttcaacttctgggccctcatccctccctgccttactaccttgaccccagcttccttaaggaggaatatgaatgttgaggtgggctgtgcactaaagtctctgtctttaagaggaactgatacataaccatccaaacgagctggggaactttgtgtaggaaatgaaccccaaattctatggcgctgaaacaggtacccatgttatcatcttcctattcctatggggtgaggagtgccagtatttaatcaatgggatttgggaagtgttcacagtgtaggagaggctaatgggacattgctgtttaggcctattgggattccatggaaggttgttttttattcctatatctgtgtatgcagtagaaattgttgcattatatgcctatgattctctcttccataagtgccaaaggggagtctcttaattgagaatagctgcatatattcacaaagttccccatatgctgggcttgggctaccagtggttcagctaagctgaagcctagcagtgtccactgggctgccgcagctgtccagcctcagcacccaccatgcggagtcaaacactgacatggtagtctccacagtggacaaacacaaggctgttctcatggatgttgtcaatatacccctaaataaacctcattatatttttactgacatttaatctgttgccaatagcttagctgtttggtctgccacttggaaagctacaactggcagattaaagcctccttttctgtggggcggctaactgtggcacaaatcacctttgctggtcaaattgtctgggtcatgcatccggatgccctctgctgagacttgggtcctgtcttgtgcagttaaatctttgaactcatttcatctttgagcttttcaaacgtgatttttcaaccaccttgctttatcttattaagtcagttttttaactgaaattttattgaaataattgtacatttacatgcagttctaagaaataatgaagagaaaacctgtgtaccctttacctagtttctcccagtggcatcatttttcaaaactatagtataatatgatacaatatcacaacaaagatattgaaattgataaaaacctcttcatattgtttagcttttttgtctattttaatttttgcttgtgcacattggtggtatgagtatgtgtaattagttttgtacaattatagaacatgtttaggctcatatatccaccacaagtcaaagtagtgaacatttgcagccccaccctaataccttctgttgccttgtataaacatcctcatctctgtccccacactcttttgtaaccaaaaatatgttttccatttctacaatttggtcatttcaaaaatgttatataaacacaattacatattatgtaactttttggtattgacagccgcagtctgtacctttgggattggtctaccacagtagacctgtggtatcctgggccctagtggttcatgctcctcccaaatgtaaaatacattcaacctttcaaagctttccaagagtctcaccccattttaacgtcagctcaaactcccaagtttaatctaaatcttatcatctcaaagtccaaaatgtcatcatcaaaagcatataaatcatgtgcagatgagatttcttggcataatacactaagcactgcccctgggactcaatacctgtccctctatggatctgtaaaactaaagtgacaactttagtttggccaacaaaagccactttctcgctacttcctacattcgctcaaggccctagcactctacaatcagtaggtggtgaggtcagccagccttgtgtctttcccttaggggcagtgagttttttcaggccctaggctggtttagagatgatttccaggagccagggcctggagtcagaaaccttagaaatttacctggtgctctactctacggcagctgagccagcagccaaaatgcaagacaaagtcctttcactcttccttcccttttacacaggcagaagagtctctccccatggtcaccatcaccagaggcccacagggagtgcttccaggcaattgccgatgttcacttaaggccaggccactgacgagtccactcagcttgttgagaatgctgccaggcctgggactcacccttcagggaagtgggctcccctctggcctggggtcagaaatgccatccaagggccaaggcctataatcagagatcccatgagcccacttgatgctctaacccctgtggttgagctggtacaaaagctgtaagacaaagtcccctttacttttatctctgctcttctaaagcaaaaagcatcaaaactaccacagctaggaatgtgcttggtatcacctgaagccagcaaggctctgagtcttagccaaggcccacagtgagctctgcctgggtattgctgctgattgtttagggtccaagggctctttaatgagcaggtgatgaatcctgccagaatttgctatttctctttaatgcagcaggttctcttttggcccagagtgtgtctagaaatgtcctggagctagggcctagaatgggttcctcatgactctgcctgaggtgactactatgactgagctggtatccaagttgcaagacaaagtcctctttactctcccctctcctctcctcaagcagaagaaaggactctttttcagagctgtgagctgtgctgcctggggttcgaggacagatggtgcaggcacttccttagccaccctggctggtgactcactaggtcatatgccctcaaatccactggctttgagcccagcagagcaccaggacttgcctagagttacagctcttgtggtctagaccacctttcaactttatttaagaccccagagcactttggcacacggtagtaaagcttgccaaaactcaattttgtctgctgggatgtgcaattcccctgtggctatggcttatctaaatgcttcctccgtgggcatcagctgagttctactaatgttggcaggactgacttccaatgaaaattcccaaagtcactatgctctccttccccaaagagcacagattctctcctcttgccaagctgtcactgacagagtatggaggagaggtggcacttagtgaaacaattcaagattttctttctaccctctttagtgcctctttcagcagcgtgatgttaaaatcaggtactgtgtttgctcacctgatttttggttcttatgaaggtccttttttaatgtagttattaaatttggtgttcctgtgggagggcaatcaatggaagctgctattcagccatcttgctccattccaagtccccaaatgtataatgtcttaaacactatgtaagtgtttataactttttctcaccaaacagactaaaacaggtgttcttgattggcagtcaacttccctccatagcataattcagaaatttgtcttgtagctttaccatcttccagggtctttttgtcaaaagacaataaattaaaagaataaaatagggaagccttgcctgaaagtgcatgcatcatttcagctcacatcccattggtgaaatctaatcacatggtcatatctacctgcaaagaagcatgagacatgtagtacctttgtttacctaactgtatttgtcattttaatttactaaaattatctctaaatcttagtattttgtccttgcttgcttggggctcaggtgttttacgatgattaaaattttcttgttatacaatcatgtcctttaaactcatgaactctttatatagagtaggctctctcaattcatgagtttacttttcttatttgcagaaaaaatgtcccacgaagttaattcaattaggtaacctttcttgctattatttctgtatgataaaatttgaaggttctagtatgcccaaagtgaataaatcattattacttttaaggagcttaaaatatagtcttggttaaatggcttacccaaggtcataaggcacatgaattttggaaacaggcttaggtttcaggtatcctaaatcttcttccactacagtatttagtacaatttttagtatagtactctagtagatcactcactcctattttacctttgatccaagcaatgcgcaggattggatgcattatcttattgatgaaggaaagataggttacataaaatcccagaaataatttgaattgtttacgaatatatttaaattagtcatatcaatattttatttatttttaaaataatgtatctaaaatacatatctttatctgtataaatattattttattgttcaattaaattactgtaaggtacaagagttaattaaacatcaaatagtgtaattctctgtgagataagtatcttaaaccacaccaaatattaaggttaagttttgcaagaacatttcctcaacatacttattcttataactttgctttcaaaacatgacttatctatgtgataggtagaagaattacccccaaagatgtatccacgtccataccccaggtacttctgaatatgttaccttatgtggaaaaaggaagttgggtagagatgttacactggtggctttccagatggaagaagaagagaccatgctataaggagtgcatgcagtctctagaaactagaaaacaaaaagagatggactcatctctagagcttcttgaatggaatgaagcctactgatatcttgactttagctcagtaggacctgtttcatatttcatgtagaactgtaagataatacatttgtgctgttataaaccaccaaggttttgtggcaatttttacaaccacaataggaaatgaattcagacttaagtgtctgaaagtgaggtgccactataatgtactaagcctgtaattatttataaattatatattcaaagctatcatataataaaattgattttcctggattgctttctgctatggttgagtgaaaaatcaagaagtagagttacaaaaattttttctatagcactgggtgctccagtgaagaaggctgagcaggagaaaattgtgcctctatgtcttaacagaaaataccttacaaaatagtgatatattccgatgaagaatcaaagcagttacttttgaggttttaaggtattcttgagagtcttcttgagattctgtgaatacatccctccaccctagaggaggcggtgtgtctcagtagacattctttccaacagaagaaaaccctctcaagtttgccccataagtcactattttacctcactgaggatttctccaaaaatcaaatcatggagtttagcatagagtataacagtagcagtttttctgcaccaacaaaatatcagatgtctataaagacttaaatatcactatatgagcagattacatccaactagacccaaagctatcactgttttactttacaatggttagcaaataagatcattttatgctaaaagctgaaaaatgcttgttgctattgttttttaaactttcaaattattcaattattgaggtttatataatatcattttaattgtataataacttgttctaactacaacctgatattaagaaggagacattatttacacaaaagtaaaaactaagaataaaatggaaatacaagtttaaagttctgtaagagcagttcattattgtgttataaaataatgatagtgacagaaatgcttttcagttaaaaaaaaaaaagctatttctgtatttcagtggcttctttatttttacagtggttctttactcattggcttttaccagaataggaaattgtgactaatgcctcactatgtttttaataatttgcatcccttcatatgcttcttattctttaatacacatttctgaaatatttatgggtgtaaattattgcctttttgtttttctatgaacttgtttaggagaaaaaatgtaatgccattttagcagtataaattaaaaagaactataagaaatattatttgactttattgcttccatattattttcaaatatatatttgcctaaagtactaacacatatgttattgatatcaacagaattgtgtgcaatcatgcttataatgtcctacctgcagattaatacagattactgacagaaaaaaatattaaattacacctctgctacaataatgtacattttaaaaatacttatatttaaataatatatcaagtaaactctcagcctcagtattataaactgaaatgtgtaacaattaacaagccttaccttttagtatattatgattttgtaatgttcttggtattttcaacaaattattctaatgggtttattttctccataagtaattatcaacaaaaatgtccccatctgtaatcagtatttattaaaataggtgacatgataggttttacttttttcaggaccagttatcatatatatcctcatccttcagccacttctagttcttatttggtcataaaatttcttaagtactatcattgtggatttaaacacattctaattttaccaccaaaaaagaatttgacaaattgcttgagaagttgatttagcattgcaaaagaaaacttaattagatactatggatcaattaatttgcttaatgaaaactttagctgtctgaggaatatggttacacagaaagacggaagtatgacttcctttattgtgtatggtgcatctgcctatgaaaagaaatggcttttcttgatttcctctatttataccccaggctgttttcttccctccccactgtcctattctgaacatagtacaggttgaaagacttataataacaaggtcagtcatctacaaagcctctctttcctctagcttgttaatctacattcttttcaccttactctgctaattgaaagctggctttcctgcggagaattgtttgatcctgcagttctctcaagtggtatctgatttcatttcctgtttataatcttactaaacttggagatggataggtattcttcttgctcctcagtcttttcttcatgccttcatcacacacatatgtacacattcaatccaattccaccatccacgatctcagacatggacacctatctacccatcctggtaatgattctaatctctggatcattatcaaatctctaacgtttttctttcagtactttccatatgacaaaactgtacatgaatgtttcctggcctttctgctcttgatctgctcttctttgatgaccttagtcttcatgtctccttaacacattctcatgttcaaaccccacaccttgtcattaccagtaattacaatgtgaacataatttaaatttcaaacaatcttccctagagtgataccttcaaaccttccactgtagcccctcttgtgccccaagctcataatatcccaacttcaatttcctaatccatcatctttcattttagcgcattcatcttatgtcacttatccagcttaaattccataatcaagtattatcattccccagcatacatgctcagttcaattgcttctttactcttccttattctccctgaattcagactaactccaactttccttctgctatatgcctgaactcatttaactaaacatggctgaagaaaaacaaatagccatagtgactcatcccacattaaattcatgatcactgacctgaagtacacgcctaaagcaacctgcaattattctttcttcccccagtctattctctccatttcttttaaatacatttctgctgtcaccttaagcctccaataccactgtcctcatccccattctcaaaagataattctgcttcctgcttcattgagaaaattgaagcaatcggaggagaactgaacacatctgcccacttccctgcatctgtgttctgctgtggctggaaaggacctgcacgtgctcccagctgttgctgttgctcactcaagcacattgctcagcaggtctctcctctgtccttgcatttctctccctaatccttttaatgaccaacactttctgtgctttcatttagagagagcctatttaaaagacaggctatatctactgtctccaattagcctccttcccttctctcttgaatcaaatccaataacgatttgcccccactactcctgggcaaacttcttttatcaaccccacaaatgaacactgtttcactaaatcaaatagtcaattatcggtcctcgtgataattgagtcatccatgcatttgacacagctagtcgctttcttttcatttgtctttcatgacgtaaaaattgcttgagttttttcttacacctttgtggttctctcctcttctctattaccacacaatgtctgctgtcccaggaccttgccattcactgagtctcctatctttgtacacattcacagtttcaagactttaaatatcagtcttaaactgatgagacagtcttaaactgaatagtctatctgacaagactagaccatgccttagaactccagaatggtttatcaaatttatttcttcgtattttctatttctttctaaaataaccacagtcttgaaatgtctaaaactgagctcctggttttatctccaaagcagattttctcaaaatcctatcttttaatggcctcctccattcttctgattgcaaagatcgaaaactttctatcactcttaacttccatttttatttcacaccagaagtaaaattctactttcaaaatagatcgagttaaactactctctaaagccttccctgctgccaatgtttcaagtctctatcatctctcacctgctttgctacaacagcattctaaacaggccttcttgcttcttttctttctttctcttcaggcaagcaatccagtcaaaacgcacattaaattctgtctctcctctgttcaaaccctccaatggcttgcagggtgactcagactaaagccaaagatctgtcagggacctacaaggatgtgtgcaactgaaggcacattccattttatctcattatcaactactctcttcaaacaatttttcagtaaccataaccataatggactcatcatccccaagatcgtcctggcaagcccttgtatttcagccctatccttgctgtcccctcagccttgatgcttttccttcagatatccatacaggtaactcacttcctttaagcctatactcaaatgtcccattggtgtgatgttagggcaatcgcagctacaatttcagcccttcccagtattttctgtcttcttttccttgatttatttatttatttatggttcccccttaggattcttactatttaacataacatgtattttacttttatttttatattctcatgcttccaaagtagaatctaagttacattttcacaggtatttccatctatttggtttcctgctgtgtccagtgtttatgacagaggcttgaatgaattactgtattttggagagaatgggagatggagaagaaaaaatgttcaggttaccaatcatctgaaaatgtcacccttatatgtggacactgtagatgccattatatttgatattcctcttggcaaaaaaacaaacaaccttgggttttactccttctcatgaatcaagatggcctggaattatttgaattgtcagggaaaagtcaaactcagataaagaatgcattttagataacactgaaacatgtcgacagaaaatagccatcgtatttccttttagcacactgctccaagtctacctgctttcttatgctgacactggtgtctcttttttctttcctgattgccactctccaaaaggccctggcatagtcccaaactgcttaatttcaatgtcttgaaagaagcttttatagccagccctctgtggtgacaaatcagggtaattgccgtggtctccccatttgaggggctttgtgctgctgcagtaattgctggctcagcagtggttttcagggaagcagctggcaagaggggaaggagatggtttctacagctgatataaaatgacaataggctcatttgtaaactcgcaaccaactatgtgcccttcccgaaagtgaagattacttctttctgagtgtaacagagaactcgtggtatgtttagttcattttataacttcttttccacttgaagcactttttgaaatttatttgattaagattcctcttacagaaatattaacacaggaaaaggcttgcagaaaccggacaaaaataaaattatctgataaaatgtatatcagtgagtgactcacagtaacagcagggctggggaggggagcatttcctggaagggatggagggagggtttgcttgctgccctggagagccaagaggaggctgagccctggtttccgagagggtgaacatgggtgtcgcagagtatcaatagctttgatgagacctggtctgacttgttatttgaatggctttaagcactaggaatggtgctcctgaatggggaaccatggaaggagagtaaaggatgcctccatctttgaaagtaaatgagtccatcacagctcaactgcagggctccacagagggaatccaactgtgagacaggtgccctggatgccgagggaagatagcagtggagtaaacagtggttgcagtggccacgcaatgtcatcactatgggtgcatttttgtcagaaatctcctggaaacatcaaaagcagatgtctggatttgttaggtgctgtggacctcactgtctggaagaataagaggccaggtgaaacatgaaaatgattgtacagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaatagtaaatatattttctcttcatgattttcttaatcacattttctctagcttactttattgtaagaatacagtatatattacatataactaataaaatgtgtgtgaatctcctgcttatattttcagttaggcttccagtcgacagtaggctattaatagtaaaatgtgggggagagtcaaaagttatacattaaattttaactgtggtgtggtagtggtaggggatttctgtcccaaactcctgtgttgttgaagggtcaactgtaatttctgagatacatgtaccctcccttgatttagagacttgacattaattcttgagttctgcagggttaggagtgttgtggggtgacagtgctaacaaaccaggcctccttggcaaataattttaacattactctcttgccttttgtaggcattttggactgttgtggcctaaagaaacacttgctatgcccaggtgctttttttttttttttttcctacagatgaggtccgctatgttgccgaggctggtcttaaacgcgtaggctcaagcgatctgcccaccttggccgcccacagtgctataattaaaggcctgagccaccctgccatccctcagctgctttcagttgtaacatttaaacttctgctagcacacacacatcaaagatcagaaaaatgttctttttaatatagaaacatgtttattttatagaaggttctataatgaaccttgaaacatatagaaaatatgtttattttatatatgttaacagttaaattcacttaattctttgctcctctcttcaattgtgtataaacttctggtaaactcatatattgggtttatcgttttagtttttctattttttatttgtaggtatccattttattattttgtaattttttttatataatttcctaactagccacctaatgtttgaacatattaagcatgatagttttaaagtctgtctggtccctccaaaatttaaatatcttatttgtgtgtggatttttttctcttgtccattttatcctctgtttttttaagttgtattcttatctccttgtgtggcttataaattttggttcaagaaaagacattgcatataaatatatagacataatttggggttcatagggatattatcttcctccagagagaatttacttttattcctggcaaaataaaataacaggtacaatttatctcactgtaatgagaggactaaggactgtgtgcttatgaagggctcgtggaacacttaggctgcaacctttatgaggtgttggttattactcatttatttttcctcctgtgttatattttgcctcatgtttttctctaggagggctcagaaatcaaatatatagtacttagtcctttgatactgctgggattctctgttttagcctctcggcaatgattttacaatgaggaaatgctgagggggaaagtgtctcggaggggatgcacatctctgagcttttcttttcccaggcagcttggctggtcaagtctgtgttgccttggtaacattgcagcactttgtaaaatgtttttgtactcgttaaaaaaagaatatttcctgttttaatcatcatccctgaagtagaattgatttgtaataaagtggtccaatatgtcgtatttggaaataccatgtttatcaagagcccatcatttctttttctctttcaagtgctaggacattttcattaatggtttcctctgtcttaagtaataaacacggttctcattaatacacagccttaccggctgttggaattataacataattagatggccttctccactaagcttgaggcagcatctctgtcctttggaaggttcattaaaatattgagaggtaggttccacccctaaagtttcttttgaattcagtaggtctgggttaagacctgagaatttgcatttccaataggttctcaaatgatgctgatgttgctggactggaaaccatggtaatattagattagcatgctgtccttcttcactttagctgaaaaaatttacagataaatttgtgggtttgttttaataaaagtaaaggaagtagtgtgctatcaaaattagactgtgagaatttgccattttttcagttttattatttattatgaacatgttgcaggttatgttgattccttcttataaaacacctgaaatgctccctccttcctattgtcttccaaaaactagggacaaatgtagaaatgtaattattatgatgtagatatatattaaaaactctttctaaagtttatatggaggagcaaaagacccagaaaaaccaacaccatactgaagtagaagagcaaagtcaggaggctcgtattatccaacctcaaatcttactataaagtgacagtaatcaaggtagtgttgtattcagtgagaagacagacaatatctcaatgaaacagaatggaaagccaagaaataaagtcaaacaagtatagttaatctttaaaaaaggaaaaagaatacaacaaaaaaggtgatgttttccacagatggtactggaaaaactggacatccacatgaggaataaaaaaataataatctagacacaaaccttacaccttctacaaacattaactcaaaatggatcatagacttaaatttgaaaggcaaataaaacacctagaggatgacataggagaaaatgtagatgaccttgggtatggtgatgacttctcagatacaacacaaaaaccataatccatgaaagaaataattaatttattggaccccattaaaggtaaaatcatctgctctatgaataatagggtcatgaacatgagaatacaggctacagactggaagaaaatatatgcaaaaggcatctgatgaggaactgttccctgaactacacagagaactcttaaaactcaacaattagaaaggaaacatccaattagaaacaggcaaaatacctgaacaagcacctcatgaaaaaaatacacacacacacatatatatatacatatatatgtatacacacacacacatacacacacaaatggcaaatcagtttcattctgttggggtattttgctagtggggcagctgtgcaagttagggcaagaggtagatgggagctctgtgctttctactcagttttgctgtgaacccaaaaccactttaaaaaagaaattctattgaagaaaaaataacaaactaaaatacattttaaaataataacaaataaattattgctgtgtaatacaagcttcacatatggggcatgttttgtgataatgatacatttaatttaaagtgaacaagcttccaaattatttatcttaaaatgatagatgtttggaagtcctcttgtcatttaatgtatttagggaaattctccttttaattctacttttttctaaaacatcctatttctattatgcctgtaattcccatttttacattttttttttagaaattaagagatacactgtttctttagaattattattttctgtgatactcataggaagaatgtactgaaactgctttatgtctcttcaactgcgtaattattatacccaagtcctggcaatgatggaaaaggaaaggtactttttggcatctgagaccaattgaaaagaactcccttttcctgtttggcatagtaaacgggaaggtgaatgtttgactgagagagcaaacatgtagatatatccctcacagatctgataatcccatttttattaggtatattctcagctcatttccaaagctaaactcagttcaaaatcataaaactgcatacagtgatgatatttctggaagaataatagtacaccacccttaatatttcagcctgcagcaaagtatagaggttggaagagacaacaaactcaaatgtcatagtcttaagagtctcgaacatattcttttttgtgattatgtacaccaccgcattcttttttttctttcttgccaaaacagaggagtcattaatagagaaactgtaagttttatcagactgaattaaaactagaaaccctgacttaattgagaaataatgcttatggggatataatttacaataactaaaatttcatcttattacaatgaccccagaatgacaatctaacaatatttgttagaatacttttttcctatacaacttacaaaactctacattatttgaataagatagtggtagaaaactgttattaatacacattgtatgacattttaaaaacaggatttaataaaatatattgtatatatagaaagttcctaaaacttaggcatacagtttaattatttaaaaaaaatcaaacctccataaacaagctacatgtcaaagagagtctattgttagccattgtgctgcctgctccctacttagtgcacaactgactttctctcctctcacttaactgttatcctgaaaggcttgataataatggtcttgctttgctatactacttttttctttccaaccatgaatgcattccaaatactatagtttatttgaatcaaatcatatatatgtatgactctatattggtttctttcagttaacatgatgttccttgagattcattcatgttgttccatgtaactataatttaataattgtacttactctatactcgtactataacacagcatgttactgtattcatctacataaaatatattggtggcacagtttattgatattttccacatcggcacatagttgggactactaaagagaatgctgctgtgaacactggtacacatacttctctagtgcacttgcatgcactgatgttcagttcacatgagaagtgaggagtccgaggtgggtgaataacttgaggtcaggagtgcaagaccagcctggccaacatggtgaaaccccctctctactaaaaatacaaaaaattagccggacgttatggtgcgtgcctgtaatcccagctactcgggaggctgaagcaggagagtcacttgaactcaggagccggaggttgcagtgagctgagattgtgccactggactccagcctgggtgacagagggagactccttctcaaaaaaagaagtgaggagtcagtctcaccagctgtgttggagcttttccattactacagttactcaccaaaatttatctctttctgtccttttaattgtagcctctttggaagataaacacaggatatacaacagtggttttaaattgcatttctttgatgagcactttggttgaatactttctctaagttgaataagccaaaatctcttttctgaaagcctcattaatgctcttgcccacttttctactggctcgtcttttttagttttagtctattattatcttatttttaaatttctattttttactattaatttaggttactcagtaatataatttattttggataaaattttatatttggcaacattgagaaatttacaaaataattttgtttatttaaaagttttgtgttttctatatataaattcatattatcaatgaaaatcatggacttgtttatcttctaaacctaacatttaatttcttttttttttctcagcacattgagtaaaagtagaaaatcattgattgttagtggtggtagtgtatattcctgtattgttactgatctccaaagaataatttaaataattcaccattaaatacatttttaaaaaatacaaatacccatatttggattataaatttaaaaaattctattttaaagacaatttctatttataatttaaagattctatcatgaatacatgttgaatttcatcattttttcttcgttttttgagtatgtgattttaatccttcatttggttcagattgtgaattatattgatgcttttaaatctcaagttatttatttaattaataaatttagacctcatataaagaatgatttaaatgtaaatttccctttttataaatattcttgtcaggtgctgttcctttagattcattcacattgttcactcattcatgtaaagttatggctggtccataaattaagttgggactgatcacccttttattctattctctggaggaccttacaagaatttagatcatttttaaaaaacaattagtagaaattaaaaagattcactagttcctcaagttttttgttggaatgttttaaattacagattacattactttaataattataggattctatatttaaaacaaatttctttctgcatctattctgacatttgtctaagaattaatatatttcatttcatttatttatttatttattttttgagacagagtctcactctgttgcccagctggattgcagtggtgccatctcagctctctgcaacctccaccttctgggttcaagtgattctcctgcctcagtctcccgagcagctgggattacaagcatctgccaccatgcctggttaatttttgtatttttagaagacacagggtttcaccatgtgggccaggctggtctcgaactcttgacctcaagtgatctacccatcttggctttccaaagttctgggattacaggcatgagccactgcgcctggcctctcatttaaattttaaaagtaacttgcaaaatatcatttataagatttttaaacataattataatatctgtaggatctgatatcatggatattagtaatttatgctgatgcttgccatgagtatttacattattattctctcttaacaattattttttgttttgttgaatacctatttgtattttttttctatttcattagtgcctgcatccaatacttcctttttttttgttttattttggcttttgggtctctccttatctctcatactttctctctttcttcctaaactttttctaaattcttgatctagattcctggattacagatgttgagacttaaaaaaatgcatatatataagatataaaagcccaaggttagcctttgttgaatccctcaagtttgatatttcatatttcattgtattttagttcaaactattttttaacttcattttgttttcttttggggggtggatggattttcgctcttgttgcccagactggagtgcaatggcatgatcttggctcactgcaacctccaccgcccaggttcaagcgattctcctgcctcagcctcccgagtagctgggattacaggcatgtaccaccaagcccaactaattttgtatttttagtagagacgggatttctccatgtaggtcaggctagtctcaaactcctgacctcaggtgatccacccacctcggcctcccaaagtgctgagattacaggtataaaccacctcacctgggcttatttatttatttattttcattaaattatttatttttttgagacagagtttcgctcttgttgcccaggctggagtgcaatggcatgatctcagctcactgcaacctccacctcccaggttcaagtgattctctgtctcggcctcccgagtagctgggattacaggcatttttagtagagatggggtttctccatgttggtcagggtggtctcgaacccccgacctcaggtgatcctcccaccttggcctcccaaagtgctgggattacaggcgtgagccaccacaaccggccttaacttcatttttgatttctcctttgatctgtgaactatgttgcttaattttcaaatcttttggagggggatattctaattttttgtgaatattgctctctcatttcattctatttaggacaccacatgtcatttgaatggcaaaacgcatttaatacgtgctttatcacctaaatataatgatataattattataaaggtgtaatcacttcttgtcatttccagtgcacttgaaaataatttatactcaatttttgttgagtcaagtgtcttaaacataataaattaagcagattgtattaattgaattgttcaaaacctctatggcttgatggatttttaactcttattttatagttattcaatgaattgtgctaaacttgttctacaattatcagtttgttcatttcttttgttgtagttccatccgtttttcattttatatattgtaaaggtatgttatcaggccggtgcagtggctcaaacctgtaatcttaccactttgggaagcaaaggaggatggatcatttgaggtcaggcgtttcagaccagcctggccaacatggtgaaaacccgcctctagtaaaaatataaaaattagccggggttggtggtgggcacctttagtcccggttactcgggaggctgaggcaggagaatcacttgaacccaggaggtggaggttgcagtgagctgagatcacaccactgtactccagcctggatgacagagtgtgactgtctcaaaaacaataataagtaaataaataaataaataataaataaataaaaggtatgttatcagatataaaaaaatctaaacattattatgtctttttgataggtttgacactatcattattaaaagtcctttttatttctagaaataatgtttgccttagatctacgttttctaataccagtattgctaaatcaattgatttttggtctctgtttggtataatttttttattcttttctttacaaattttctgtacttttatgtcttagataaaccttacagagacagaatatagggtttttcttttgcttttgtttttattttatttatttatttatttatttagtgtagtgtaaaaaacttcataagaagcgaggcatgatgggtcattcttgcaatcccagcactttaaaagtcctagacgatcagctcgcttgaggccaggagttcaagaccagcctgggcaacatagcaaaactccgtctctacaaaaattagccagaagtggtggtgtgtgtgcctgtagtcttatcaggaggctggggcaagaggatcacttgagctggggaggtcacgttagagctgcagtgaactgtgacccccacacttcagcctggttgatagtgagatactgtctaaaaaaatatattagtaaaaactttataaggttgcgtttattctatttacctgctatataactaataccttgttttgattacattctaccaccttaccttgtgccttacatttttccgccacatttgtttctttttaatctcctttgcttttgcattgtttatgaaacaaactgtttatttttttctatatgtttattttgaagttttatacatttcactaacgtagttacttttcttttatacttctaataagtgattacctgaaagatcacgacatttgctaaagtttttactttacaacagtggcccagagtattttgtacgcccttgaatgttctttggatacttttcaaggatctagaaggtcaaaactattttcataataaaatgtagatggtatttgcctctttcactctcattcattcataggtataaagttaaagttttccagaagctaaacgatgtgtggtattacaggagagtaaatgtggaaacatatattataaatcgtctgccttctattaaaccaatcattaatgtacacgtttttttttcctgtcttcttgccagttttactatgctctttgctgtctttggttctctgaagacacatgccaaagtgccttggtgtgcttatatttatctagcttttgttttgtttgtcttctgaatctgtgtattgacttctttttatctatttgtgaaaattcttagccatcatctctttcaatatatcttctgttcattccctttcttagctgtgcttgggttgggactcaagtttgaagttttgtatttctcagtgtaacacctttttctcttattctcatatatgttttttccaaacttttgtctctccaatcatcattctagaccttttttactgagccatctttctattcactaattctttctttagctgctttttaatgtgttgttaaacccaactttacgtttcataaatatttatttgtctaatttctaaatggaacattttataatctattatctcagatataccctgatgaaagtttcaattttgtatcttatattcatatacatagcaaacttaattaatgtctgtattagaaaattccaatatctgaaatgcctaaatattcagttctgctgtctattgtttttattcttcatgttattctcctgatgtacttcatgaagttttatttccttatattcttggttatttttattctcttccaagaaacaagtcttatgaaaatatattgacataagtaatgttattgtcatccagaaagaatttccattttctttagtcaggagcctgacagaattccaggatcatcataaaccatttaaagcttggcattttctggatcatctcaatggcttaaatctgagctccagtcctggcaagggcttgatgacttctgccttaactttgtaattaggatgcagacatttctgatcctaagtaaaagcagagcatgtttactaaggcctccacatgtggaagattctggactttaacattttgatccaaacctgtgagactggccaatgtagctgattctctcatgtgacatttccgtgtagaaagcacacctatggcaaaagttgacccgcatttgtattaatgattaacctctctcaattttcatattcctataaatttttcctggttgtcttttaatagcttgtaaaacatctagtgctttaagcatattcttttccagtttcctaaggtaacattagatggtgggttgtctacattctctaatatgcaactactggaagtgtaagctataatatccttttcattttaactcctgtaattattctgacacagtaaatatatattaaactaagtcatagttttctttatgggatggttatctattaagcttcatttaccttttcaaaactgtgttgttatctgatcaactatacctggccatataagcaatacaaaataatcagttattatagctggttcttattatgttattattaaccagtgaagtctctatgtaatgcatatgttagtaacctaaaagattacagaatacattatataattaaaagagcaaggcatcttggttcaaattccaattctaacttatatcaagtttgattcatttgttaagctaatttatttaaatcacaatcccttaatttgttaattcagggactttatagctcataggcttattgtaagacaaactgagataatgagatggtgaataatccaattattttagagagtaaacataattaatggaaagaagatgagatctatgagtagacgacagtaatatttcaaatcttgcatttcaaattcttgcattgttattagtcaactgtcaccacattaatgctgcaaaacaaaccatccccttactagctggaatacaacaataagtatttctttctttctgaaagtaaactgattgtcattagccaccagtttggagctagctgggcttggtccaggtgttaagctgagctctggtctgctggcatgtgttcctatcctgggtatgagtttttcatgataatggcaaaagcacaagatactaagctaactctacttgcgacacattcattaatatcctattgatgatagaaggtctcatgagccaaaaaaagaaaaaaatatctaggaggaggacttaactctgccaaccataaagccaacgtaaattatatgaagtgggaggtatatcctcccgcacagagttgtgatgagaaagaaattgaatgccacatgaatatgttgttagaaatgtcatacttatttgttaagtgtttgtgtatatgtttgactctcaagaaaatcagatcataaaaagaggagtggctcatctcacaaaatctttgtttggaaatcgatctgcctttattaagcactagaggctaaagagttgatttcaatgccatttgatatatgaatacactagcataaattgtattcatctaagatcaatgattaaaaggagggcatttatcattctcccctatcaggcacagaggagaagtggtgtgccgccctagtggtattgccataagatgtctatctgatttgctttctttactcacttcaacattctgtattaaagcacattcccaattaataaaatgtcagtaattggtaaacaagtgcgatgcatcaatgaattctattataaataagtatttttttctgtaagaattgatagagtgggaaatataatccatggcaggttggatggcataaacacttgataaatgctggtagaaacgtataagaaattcttatgagaggtttacattcatttactgaagccaaatctggtttaatgtacttttttgcatcaatcaatttgataattttatgtgagtttttaatactacatgaaaaatacctaaaatatttttaatatttgcatctaaatatttttagatataagatatctaaaataagaagttttgacagttgattgtattccattttcttgcagattgtctacatgggctggtgtgaagcccgggagcaagaccccctccaggacagagtgtactccccgaccttcctggccctgaggggctcatgtctctacaagtttctggcacctccagtacgtgttttattgaaatgtattggtcgtttccatattatcacaagagattgacaccaacttaacagcaccaaatagtataccatcaatatttttaaaaaataatatagagaaaaagtagaaatcagtttatctgatttaacttactaaaatatatattctgacattaaacatttgctttaacacccttgaaaagtctggaacttacttctttataaatagtgaacctataaaataatggatcaaattataatgccattacaaatctcatgacgacatgggaaaggagattttaagaaacattttcaagcatatgtcagtgtattttgtttatggaataaaaattaaagaaatgaatatatcaaaagtgaaataaaaaagaataaactgttttagggctatacatgaatgaacatgtttactaaactcttattttccaaggatcttttgaaagttcttttaaatttattcagcacttttaattactagtaatttattattagcaaagaataataaggaaatttcaaaatgatagcatcttatctagctactattaagtctatctcaccctatggtaatcccataggatgatgttaactctcatggtgttcaacatttaaattagaggattctatccttggcaaacaacacaaatacattctggtaagctatcatttatgacaagtcgaacttgcttatttatgttgtacaggtctctctatataaaatcaataacattttcatcttctattatattctatatcctagttattgagatttgtactagatatgtatagatacctattgcacctcaagtcttgcttttggaaacatgtaccttgcagctcagaagacacttaataaatatttattgaatataaataccaaatgccagaccagtcacttgcaggtctaataatacataagatttagaaatcatcaggtctaacttgctgctgttttaaatgtctgtctctacacaaagtttaaagcactaggaagacagaggaaaaattgatatttatatattttactctattcctactctgaataatttatttgacaagacagttaaatatagtttccaacctaagtaagtgaaataactgcattatgctttgggtatgtttgcaatgtcacagtcatcttggaatttcttaatataaatgatgtatatttaaaaaatatagctgtgttgaggtctggtattctctgtatttaactagtggtaaattaaaaaaaaaatatgagtgtggaatgtaaatacttagtatttataggtagagaatgcgtatattatttaagatatataaggacactgggcaaatgagaactgttgcacataatataaatcatttgctgaaagcataagacaaatggtaacaaagcttggaaaagaggaaacaaaagcattatgtagggtcctttatgagcatggcttcacagatgagagactagatacatctgtgaaagttttttcttatttttcactatattatgcaaatcaaatacagtggtaaataactttctaaaacaaattaaacattattttcttatcttttaaaggtgaccacctgggactggacgagagcagagaaaacattctcagtttatgagattatgtgcaagatcctcaaggtatgatcaatatgtagtcagtatttgaatggcttttcctcagcaaatagtgcctctgggctcataagcagctcatgaaaacaaatcattcatggaatgaaagaagagacacgataaagacaaatgaaagagaaagaaaataaactggacaaaaaagagaaaatatagaatgcacagaagtgcactggcactcagctatctgcttaaataacttgcaagcagactctgcagtcccaccgtgggtgagggaacagggagaagctcctcaggagttcactggggaagaagaaaattcagttgaaagtagtctgaatttaaacgttggttgttaccatgtttttttttttaattctttttttctgaataaaatgcaaaagagaaagatttgggtgagacctggaattagaaaatatagaaaatatcaggaaaaatgcaaagaaaagttttgctgttttgttcttaatctcatggcttgaccatctttttgcatatgtaaaagaacattcgattgtcatatatcagttgaatttcatgccatatgcaggattattacaatatcaagccatcacaaattctataaaatgtcacatggtttctatagcgttttttaaagaattaaaattggaataacctataaaacatgaagactaatatatattcactttctactttagggtttgtaggcttggactcaccacagattgataattaaattcctgcataaggttgaccttgtttctgtatccaaggggagctaatttccctttgctttatgttagctatttctcttcccgttaaagacttagcagagtagaaaaatgctgaaacatttaaaatataataaaatgcatcaaaagtgtctgaaggcagagagacaaaaattataattacctcaaaattgtttatagtttctgttccttatagagaactttggattaaagctgaagttctctgaagtgcaaaatccagccaaaagtatagttcattgattgctcatcactgtgcatgctttgagttcttctgtaggcgtaatggtggaaggacaacctgaaatacttgagtgtattgttagtaaagaagggtctgacaatttcttaaacagaggctagtatctgaggaaaaggagatcatacacgactccagttttctgaaataattgccaaaatggctaatgagatagctttcttttttttggagatggagtcttgctctgttgcttaggctggagtgcagtggtgtgatctcggctcactgcaacctccacctcccaggttcaagcaactctcctgcctcagcctcctgagtagctgggactacaggcacatgccaccatgcccagctaactttttgcattttagtagagacagggtttccccatgttgcccaagctggtcttgaactcctgagctcaggcaatctgcctacctccgcctcccaaagtgttaggattacaggcatgagccaccgcgccagggcgaactgtgtatttttaggaaagctactcatgtaattaggggaagaaaagaaagaaagaaaagaaaagaaggaaaagaaaagaagaaaagaaaaggaaagaaggaaggaaagaaggagggaaggagagagagagagaaagaaggaaagaagaaagaaagagaaagaaagagagacagtaagaaggaaagaagaaagaaagaaagagaaagaaagaaagaaagagagagagagaaagaaggaaggaaggaaggaagaaaaagagaaagaaagaaaagaaagaaagaaagaagaaagaaagaaagagaaaaaagaaagggaggaagggcagggagtgcacagaggggagaaaggaaagaaggaaggagaaggaagggagggagggagggagaaggaaggaaggaaagaaaactgcctcaacaaatcaactttgtctattctctatctgtacactaatacaacttttatcatagtaataacgcaacacatatttatatattcttacttagacttaaattattttctaaccactctccaagtagctgcatgatcttttaaatcctctcttttaaaaaaagctatttaaacattagaacataatgcagtttactatagtagttaaaaaggataattttaaaggaaataataaacattatgtttagctctatcaagatatacaaacaatatgttctatctctttgttacaatttttgacaaagattatgcaattcatgatctgctattttgtgtaaaaatatgtcttgagatttttttctatgacagttaatgttccttaaaaacactgataactttttgatagatttcatctatcccatcatttgcttgtattcattgagtccactttaaaattttacatttagttttttcccccacttgttattgctatcaggcatatcacaacaatcattatttgaatggtttaatagaaaattaaatgtttgctatataccaggtaacctcagcacttgttatgtggctgagaaaaatgcagaaaaagccactgctttcattgagcttgcattttattaggtgatatgatgttaagtaaatcaataaagaagacaaaaatagtaagtaaataaatgagacaaaataataatatgtaggaaggactgatatttgctcagacttttatgcaaattcttatttcctttagtctaaattctgagctttggaaaccccatgtggaaaaatattttaatgtattcaagatattaaatccatgtgtacaaattgcctcctacaagtcatcttaacttatgcggccatcagaagtgtctatgagagtgcctgtatatttacattctgaccaaattaaaatcaaagactacttctcattttaactttctatatacaattttctataagccttagtttacttgaatttttttaatacttcaagttctgggatacatgtgcagaacgtacagttttgttacgtaggtatacatgtaccatggtggtttgctgcacctatccacccatcatctaggttttaggccctgcatgtattaggtatttgtcctaatgatgtctctccccttgcccccaacctcccaacaggccctggtgtgtgatgttctacttgggaaaatgtttacataggttagtgaggcctggcgataagtattctcatacatcaaatacaatgtaaatctaccttcaattgttgtatgtaatcaaggaagtccccctccccttagtaagtacaatgctggtgctttatgctttgtggcttgacattagacatataaagccatccttcaagcattccttttcccaaaggaaaatttcatgtagcatgagaacagaggagtggcttctagattcgatgctaatggattattttcctgcatgcagattaccttctggccttctcctgtgtcaggatcactggttgataaggaagccagtcagataggtggggcaggtgagcaaataagaaggggcatcttctacagcctaaatcagagggggagtcttctacagcccagccctctcctgccatgaggtatcacttctgatgcaagctgtgcaagttgtagacttctgcctccagaaaatggatccctcaggtgaggctaattaaaagtcagatttgaatgtctggatcacagaagaacttgcctgtgaccattaatcaggaaaatcctgtcccttctgatgtgttcataatgaagctacaccagtaataacaaaaatgaagcaataaggtttatctggtacatatagtttatatgtatgtgccaggtgttgtcctaagtgcttagtatatgaattcagtttgtatttacagcaccactatctgtcagttattgttattcccattttagagatttggaaactgaggcaaaaagcagtttaagtaaatagcctaaggtcacacagctagtaaatatcagagctaaagatatgaatcttgcaatgtgtcaaaattctgtgctcttgcacatgatactacactgtctctgtctctcagcgtaaatattgataatttgggaaaaaagatgggaaccagagagccagcctggtactgatgagagagcaaaggtttcagaaaaaggaatttggcaacaaatgccacttctgttactaaaacattaccctttatgagtgtattgggcactatgaacttcagttcttcatctgtgaaatgcagctatggatgcagagggtgctgtgaagattaggaattggttaactgatttgtgaatgcatttttgtctgttaattcatatcagttacttcgagtaccttctatgtgccaagcactccactaggtattaaggataaatacaacagtataagagagttgaactcacaaaaattccagctgatgaaggagtttaggaagggcattttggaggaggcttttaatgaactgaaacctaagtgactgtgaaagggctccacagaggaagatgtgtcatggcaggggttggagtccagccagtaggaggggaggagcaacctggtccaaggaataatgtataaacttgcccagagctacaaagaagtatgtgtcccttcaacaaggcaaacaagtttgttacagctgtagtcatcttgggtatgaggttggtgttggtgtttggatggaacagatcataggaaaaggccttaataaagcacatgaactttatctgaggaacaaaggacagccactaaagcatgtcaagcatagggagggactgaggttgcccatttaaaaatcctcttcgaatgcaacgtgagatggagatgaaggggccagaggggagtgctcctgggacatcttctggtcaaccagggcatggacagcgggctaggaggagagaggcagaggagtcgggcctgaatagatagtgccctcacagtagctactcacctgcatagaccagccttcttgcaccgctctggtttgactcgttttgctctgattctagcctgagctgtaactccctaacacggcactgtagtggtgcatggctggaaaaaagacaacctgcattttcaattacagactaaaatctcaagaaagcctctaattcttcctattgttatgtcatattttcttagcctattctcttgtctaatctactggaacttatattaaacctttttcattcttttttgaaattaatatacacttcccattctcacttttaggagatgatcctacttcctacatgcaaactctctcagcattgcaaatgcctcctggcagccctatcctgacagataactatccttgctcttatctaatactaagcctcccattgggtaacagatctcaaccacacttacataaacagcaattctatcctgatgactccaaatgcatatgttctgcccagatcttgtccccgaactctaagtattcaacagtttatatttctgcctactgacatacctagtagaaatgtccatgttacacgtctcaaaatttaggatcaacaattggagagaatgtaaagcaacatggaagttagagaaaagagaaaaacaaaagcaaaaactagagtttggctatttttttagaaactcatggcaattagctgagatgatactaagttatagcacggagtacattttagcattacagacctctggtgcctgccaacaggggtgtgttgagctgttagggaaactgtcatttattcaactttgggactttaataattaagaaaatgcaaaactaggaatataaaattaggcatgaaagtgaatatatatcaagaatgagaaaaagctcatgatgcagaataaagttggcaaatgccacaaacattgaaaatctatgaaaaataccctatatttgtaattaattcactaagacacttattgagtactttttctcctatatttttggggggctgtgtattctttgatcacctctttgaataaaaaggattttgtaaaccagtgtctatgggaaaaagaagtagaccccctgcatcttgccctcatctctctgggcaccatgatcacctgcctcccagaggatacccaaggcctttagcccagggacagctaccaatggaacttagatctcatcctacagctgaattcaggagtacagttgcaatgatcaggttcttcctagtgagaggaagatcggacgtaactgcatgacttgaagcccaagtgtagtagttgttatgctaacagagcatacatggggaacatagaggagtagtgaaaggaatgtctgtcttcattcataatagatgagcagtgtatcatttgtataaaaatgtactccctatcatttggccaggaaacccttaaaaactagaggatcattttgtttgtagatattcaacaactgcctgtttcagagctagcaatagatttagcaagaacaagtctttggatgacagagattatttttttaaacagtatttttcatgatactgtttttcagcctggtattacaaataagtttacatttttgataaaatatacatagtgagcaatacagtcacactgatattcatctaaaatcatttttagaaaaaaggagaaaacatgcttggcagggttgaatgaggagggtattcagagtgaatgcaggtgggagatggggaaggagaaagagggattgatcaactaagtagatatgttatgcggaaggtgaaataggagccttatttctcactgttagagatgaaagtcataaatacagaaagaaagaagccaagaataaattctgttgtattggattacaattagaaatattggtatgcagcctcagtttgtagtgtgtgtttgtgtgtgtgtgtgtgtgtgcatgcatgtatatgtatgcagctgtaccttactctgtccccaaaatatctggggtcagagagttctcaatagcaaggagcacactcagcaaagctctccatttctcaatattattctccactgcaaaaagccagaactctgtagagaaatgtttgatggctgggttgtggcgtagaaagtcaaagatgaggctaagtcatattactgtgctaggaaataaggaggtgttcagagaatgatggagatagatgaaaagacataaaagcaactttcaagagcatctattgggcaaattcgggacaaattgagcaattctgggataaaataaatgttagcaatggattataactcagcaaataaaataggaaaccattaagtctatcttcataaaaataaagaagtgaaaaatgtgacaagggacaaagaacttacttagtttcaaagtacctcctcagaaataacttactgtaattataaaagaataaaggagaactttacagagcacaaaagtgacagcattgccttaacaaattgatcaaagtgaacacttcattaaagcaacacatcaaaaattatgcatgtctgatagggagacagactataataattagcaaaatagcaggttcatgacattcccactaaagctgggtacaaatgaaatctaactaggaggaaacatctatctaatgtaatgtaaaggagaaaaccaatgtaatctaaccaaatctaatgtgatttaacctattctagtcctgagaaaatctccaacaaacccaagtgagacacatttcatataaaatgaatgtcctattttcttcaatagtgtcaaagtcattaaagttaggaaaagatcaaggcatttttctcactgaaggcaagtagcatcacagaacaaccacatgcagcagaggattctgaactggtgagtcatgaatgaagcccaaggactagaccacatcagagtccttgctttgatgattgcattgtgtttatgtaggtgaatgccctaatgttcttgtttgtagaaggtacacacacactgaagtatgagggtgggaggtaatgaagtatcacattggtagttaacaaacagttcagaaaataagtatttgtaattcacttgcaaatgttctttaaatctgattgtattaaaaattattccatgtcaggagtttctatataaatagaaatgcaaaacaagcaaacaagaaaaagtgaacctgcctcatatagagacaacacagtaaattattatagaaatccctaaaggctaccaggcttgtacaacattctaagacagtgctaaaactgtgctcaaattaagaatagctaagaagaaatactaacaaaaataagtagaataaacaaaggcataaatagaaaaaataactttttaaaattaaaataatggaataattacatcttcaataaataatgtgtcaatttatttataacccttatattttgatatcaaatatatattttcccataccccatatttacttaaatgtgattgaaaagctaaatctaatattattatttcttttatcgcaactgcttgcattttaatagaaaagagatgctccaaattagagtatgtttcttataatatggtttaaaataaaagcaaaataaatcaatatacaaaatatagaaatatataatatacacataaattaaggtataacggaagataatacatgatataagagtatatcgatatcattattaggcaaatgctaaaggtttgggagagaccaaaatatttccagcagactgtaatttatgtgaagaatcattttacgatagaattttatatcaatggcaggtattagtagaaactattgtaagaacgccaaagtaaccacttttttaaaaagttacattttagggaggccatttgtctttatctgttttctgttgctataactgaataccacagtctgagtagttaataaggaacagaggtttaactattagctcatgggtctggagactgtgaagtccaagagcatgatgctagcatgtcgtgaaggtctaccagttgtgtcataacacagagggaagcatcacaaggagagatagcaagcatagtaactcaggtctttttcttctctttataaagctaataaacccatcacggggccccatcctgatgaccttatctaattctaattggctccccaagtccctacctcttatcaacatataaatttggttattaagtttgcaacacatacaattttggagacatattcaaaccatagtaccatcttagtaaaaagaggtgtctctgcattttctgactataattatatccattttcatttttaaagtaatttttcttaaaaaggttgattgctttacattttattaagtaatttaaaattaatatggttatttttttactgtaacactttataattaaattagtataaaagtttagtctcttcctaagctacaagcttctgaaaatatgtttttagtttttcctctgataatagaactttaattccctggtgatttttaaaaaacgttacaggccgtgcacttaggttttagtgttgctgctctgggtgagaactaaggttcagccattcctcgttctgtctatgaacatgccagagagaacacatcagaaggaagtcactgccatccacaaagctaatcccagcaacttcaaatccagcttcctgtcttaaaaatataataatcgtcattgattaaaaacataattttattttttatttttgttatctaataacattttcttggtttattaatattttatcacatatccttttgtgaaagtgactcccataaattccccatctgttatataaagtacttatttcccttttaccaagacatctttcaagtgccaagtattaattaattaattctcatgtttcaaaatttgtttcattgacctatatttgctcttaaaagttcaaagacatcattgtttcatactcttttcttgttttgtttttttttccaaggagaggtttctgattcttttagctagatcttgtctagagatacctatgttcttcatctttcgcacattattattattattattattattattattattattattattttgctttaagttctgggatacatgtgcaaaatgtgcaggtttcttacctaggtatacgtgtaccatggtgatttcctgcacctatcgacctgtcctctaaggtacctcccctgacccttaaaccctcaacaggccctgatgtgtgttgtttcccaccctgtgtccatgtgttctcatagttcaacttccatttgtgagtgagaacatgtcagtgatagtttgctgaggatgatgacttccagttcatccatgtccctgcaaaggacatgatctcatttctttttatggctatgtagtattccatggtgtatatgtaccacattttctttattcagtctgtcattggtgggcatttgggttggttccacgactttgcaattgtaaatagtgctgcagtaaacatacgtgtgcatgtgtctttatagctgaatgatttataatcctttgggcatatacccagtaataagatttaaaagaatctctgggacacattcaaagcagagtgtagaggaaaatttatagcaataaatgcccacaagagaaagcaggaaagatccaaaattgacaccctaacatcacaattaaaagaactagaaaagcgagagcaaacacattcaaaagctagcagaaggcaagaaataactaaaatcagagcagaactgaaggaaatagagatttaaaaaaaaaacccttcaaagaattagtgaatccaggagatggttttttcaaaggatcaacaaaattgatagaccactagctagactaataaagaaaaaagagagaagaatcaaatagacgcaataaaaaatgataaaggggatatcaccactgatcccacagaaatacaaactaccatcagagaatactacaaacaactctatgcaaataaactagaaaatctagaagaaatggataaattcctcgacacatacaccatcccaagactaaaccaggaagaagttgaatctctgaatagaccaataacaggatctgaaattgtggcaataatcaatagcttaccaacgaaaaagagtccaggaccagatggactcacagccgaattctaccagagatacaaggaggaactggtaccattccttctgaaactattccaatcaatagaaaaagagggaatcctccctaactcattttatgaggccagcatcatcctgatacaaaagcctggcagagacacaaccaaaaaagagaattttagactaatatccttgatgaacattgatgcaaaaatcctcaataaaatactggcaaaccaaatccagcagcacatcaaaaagcttatccaccatgatcaagtgggcttcatccctgggatgcaaggctggttcaatataggcaaatcaataaatgtaatccagcatagaaacagaaccaaagacaaaaaccacatgattatctcaatagatgcagaaaaggcctttgacaaaattcaacaacgtttcatgctaaaaactctcaataaattaggtattgatgggatgtatctcaaaataataagagctgtctatgacaaacccacagccaatatcatactgaatgggcaaaaactggaagcattccctttgaaaactggcacaagacagggatgccctctctcaccactcctattcaacatagtgttggaagttctggccagggcgattaagcaggagaaggaaataaagggtattcaattaggaaaagaagaagtcaaattgtccctgtttgcagatgacatgattgtatatctagaaaaccccattgtctcagcccaaaatctcctgaagctgataagcaacttcagcaaagtctcaggatacaaaatcaatatacaaaaatcacaagcattcttatacaccaataatagacaaacagagagccaaatcttgagggaactcccattcacaattgcttcaaagagaataaaatacctaggaatccaacttacaagggatgtgaaggacctcttcaaggagaactacaaaccacttctcaaggaaatgaaagaggatacaaacaaatggaagaacattccatgctcatgggtaggaagaatcaatatcatgaaaatggccatactgcccaaggtaatttatagattcaatgccatcccaatcaagctaccaatgactttcttcaaagaattggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaatgacgccacatatctagaactatctgatctttgacaaacctgagaaaaacaagcaatggggaaaggattccctatttaataaatggtgctgggaaaactggctagccatatgtagaaagctgaaactggatcccttccttacaccttatacaaaaattaattccagatggattaaagacttaaatgttagacctaaaaccataaaaaccctagaagaaaacctaggcattaccattcaggacatagacatgggcaaggacttcatgtctaaaaaaccaaaagcaatggcaacaaaagccaaaattgacaaatgggatctaattaaactaaagagcttctgcacagcaaaagaaactaccatctgagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagatatttatgcagccaaaagacacataaaaaaatgctcatcatcactggccatcagagaaatgcaaatcaaaaccacagtaagataccatctcacaccagttagaatggcgatcattaaaaagtcaggaaacaacaggtgctggagaggatgtggagaaataggaacacttttacactggtgatgggactgtaaactagttcaaccattgtggaagttagtgtggtgattcctcagagatctagaactagaaatgccatttgacccagcaatcccattcctaggtatatacccaaaggactataaatcatgctgctataaagacacatgcacacgtatgtttattgcggcactattcacaatagcaaagacttggaaccaagccaaatgtgcaacaatcatagactggattaagaaaatgtggcacatatacaccatggaatattatgcagccataaaaaatgatgagttcatgtcctttgtagggacatggatgaaattggaaatcatcattctcagtaaactatcgcaaggacaaaaaactaaacaccacatgttctcactcacagatgggaattgaacaatgagaacacatggacacaggaaggggaacatcacactctggggactgttgtggggtggggggaggggggagggatagcattaggagatatatctaatgctaaatgacaagttaatgggtgcagcacagcagcatggcacatgtatacatatgtaactaacctgcacattgtgcacatgtaccctaaaacttaaagtataataataataaaaaaaaatgtctggatcaaatggtatttctgatgctagatccttgaggaattgccacattgtgttccaaaatggttgaactaatttacattctcaccaacagtgtaaaagtattcctatttctccacagtctctccaccatctattgtttcttaactttttaataatcaccattctaactagcatgagatggtatctcattgtggttagatttgcatttctgtaatgatcagtgatcttgagtattttttttcacatgtttttggccacataaaagtcttctcttgagaagtgcctgttcatatcctctgcacactttttgatggggttgtttgttttttttcttgtaaatttgtttaagttccttgtaaattctagatattagacctttgtcagatgggtaggttgcaaaagttttctccaattctgtaggtggcctgttcactctgatgatagtttattttgctgtgcagaagctctttagtttaattagatctcatttatcaatcttggcttttgttgcaattgctttttgcatttttgacatgaattcttggcttatccctatgtcctgaatgatattgcctaggttttcttctagggtttttatgattttgggttttacatttaagtgtttaatctatattgagttaatttttgtttaaggtgtaaggaagtagtccagtttcacttttctgcaaatggctcaccagttttcccagcatcatttattaaatagggaatccttttcccatgcttgtttttgtcaggtttgtcgaagatcagacagttatagatgtgtagtattatttctgaagtctctgttctgttccattgcctgttttgataccagtaccatgctgttttggttactgtagccttgtagtatagtttgaagtcaggcagcctgatgcctccaacttcattctttttccttaggattgtcttggctatagagggtctcctttgatttcacatgaaatttgaagtagtttttcctaattttgtgaagaatgtcaatgatagttggatgggaatagcattgaatctataaattaatttgggcattgtggccattttcatgatattgattcttcttatccatgaggatggaatatttttccatttgtttgtgtcctctcttatttccttgagcagtggtttgtagttctccttgatgaggtccttcacatccctgttagctgtatttctaggtattttattctctttgtagccattgtgaatgggagttcattcatgatttggctctctgcttgtctattgttggtgtaaaggaatgcctgtgatttttgcaaatggattttgtatgttgagactttgctgaagttgcttatgagtttaaggaattttttggctgggatgattgggttttctaaatatagaaatatgtcatctgcaaaaagagacaatttgactgcctctcttcctatctgaatacgctttatttctttctcttgcctgattgccctggccagaatttccaatactatgttgaataggagtggtgagagagggcatccttgtctcataccggtattcaaagggaatgcttccagcttttgcccattcaatattatatctgttgtgggtttgtcacaaatagctctgattattttgagatatgttccatcaatacctagtttattgagagtttttaacatgaagtgatgttgaattttatcaaaggccttctctgcatctattgagattatcacgtgttttctgtcattggttctgtcaatgtgatgaacacatttattgatttaggtatgttgaaccagctttgcatcccagggatgaagctgacttgatcatggtgggtaagttttttgatgtgctgctggattcggtttgccagtattttattgaagatttcacatcaatattcatcagggatattagcctgaagttttgtttttttattgtgtctctttccagttttggtattaggattacactggcttcataaaatgagttaaggaggagtccctccttttggattgtttggaatagtttcagaaggaatggtaccagctcctttttgtacctctggtagaattcagctgtgaatttccctggtcctgggctttttttggttggtaggctattaattactgcctcaatttcagaacttgttattggtctattcagggattagacttttcctgatttagtcttgggagggtgtatgtgtccaggaatttatttatttttctagattttctagtttatttgtgtagaggtatttatagtattctctgatggtagtttgtatttctctggggtcagtagtgatatcccctttaacctttttttgttgtgtttatttgattctactctcttttcttcttagtttagctagcagtctatctattttgttttttcaaaaaaccagcacctggatttattgatttttggagggattttgtgtctctatctccttcaattctgctctgacctgagttatttcttgtcttctgctaactattgaattagtttgctcttgcctctctagctcttttaattgtgatgttagggtgtagatttgagatctttctagctttctgatgtgggcatttagtgctataagtttccctctaaacactggtttagctatgtcccagagattcttgtacattgcacctttgttctcatttgttttgaagaacttcttgatttctgctttaatttcattatttaaccaggagtcattaagtagcagtttgttcagtttccatgtaattgtgtgtgtttgagtgagtttcttaatcctgagttctaattttattgcagtatggtctaagagactgtttgttatgatttcagttcttttgcattttctcatgagtgtcttacttccacttatgtggttgattttataataaatgccaagtggcattcagaataatgtattttctgctgatttggggtggagagttctgtagatgtctattaggtccacttgatctagagctgagttcaagtcctgaatatccttgttaattttctctcattcatctttctaatattgacaactgggtgttaaagtctcctattattatgtggcagtctaagtttctttgtaggtctctaagaacttgatttatgaatctggatgctcctctattgggtgcatatatatttaggatagttagctcttcttgttgcattgatccctttatcattatgtaatgctcttctttgtctttttaaatctttgttggtttaaagtctgttttttcagagactaggattgcaacccctacttttttttttccatctccttggtaaattttcttccatccctttattctgagcctatgtgtgtctttgcacatgagatggttctcctgaatacagcacactgatgggtcttgactctttatccaatttgccaatctgtgtcttttaattggggcattttgcccagttacatttaaggttggtattattatatgtgaatttgatcctgtcatcatgatgttatctgattattttggccattagttgatgcagtttcttcatagtgtcattggtctttatattttggtgtgtttttgcagtggctggtacccgtttttcctttccatattttgtgcttcttttgggagctcttgtgaggcaggcctggtggtaacgaaatctctcagcatttgcttgtctagaaaggattttatttctcctttgtttatgaagcttagtttgactggatatgtaacaatgttgaatattggttcccaatctcttatggcttgtagaatttctgctgagagatccactgttagtctgatgggcttccttttgtaagtgacctggcctttctctctggctgcccttagcagtttttccttcatttcaaccttggaaaatctaatgattatgtgtcttggggtatatcttctcatagagtatcttagtgttgttctctgcatttcctgaatttgcatggtggcctttcttgctagattggggaagttctcctggatattatcttgaagtgtgtttttcagcttgtttccattctccctgtctccttcaggtactccaggtttggactttttatgaagtcccatatttctcagaggctttgttcattccttttcattcatttttctctggttttttctgtatggcttatttcagcaaggtggtctccaaacaatgatatcctttcttccatttggttgacttggctattgatgcttgtgtatgcttcacaaagttctcgtgctgtgttacgcagcaccatcagttcatttgtgtgtatgttcttctctaaactggttactctagttaacagttcctctaaccttttatcaaggtttttagcttctttgcattgtgttaaaacatgctcctttagctcaacataccgtttctgattcttttagttttttcttatctagtgacacctatttattatctttctcacactattgtttttaaataatgtcatttgcactccattttttttgacaggtgtgagtaaagcatagttttctcaaaatatttttaaataatttcatattattctgtaatttatcttataattctcaaaatgtttgtttattcttttgtttaaaaagttatattctcactattttttaaagatatttctaaaacaatgcaagattattatttaggtcaaataagtatttatcagcaatgtgatttggtaatagaaagattcagtcactttatctcattaagaatttaatatgtacacaaaagctatctaattctgttttccaatatttggagtgaaaaaaattcacacatatacaaaataaaccaacatcttatatttatctctctcaaaatatatttttggggtattatttcctcattaaagtgagtctaaaagcaatatatttatgaatgattatggatttccatgttgcagaaatttgttcccctttaagctgagtcagaagataatccaaatatactgaaaataagcactggaaaagcatagctgttttaaatcctaacattttaatttactgtagtaattttaataaaaatgtgagagtacatctatattaggaaaatctacctatcatatgcaaataaatctttatgaattgtgaataaatcgaatgcttaaaaatattatgtttaataatgacatcttccataataatatctggttagtaaaattttatatggacacccataacataacatatccttaatgtaagaaaaaagctagaaaatgggttttgttgcacaaataatttggtgccaatctcaaggattcatcccttagaatgagaattacttttaatgctctatttagcttaaattccttcaggtctatttcaggtttttccataacctttctagacttaatttgtttagatttctgtttacagaaatgttctgccttgcaaatttacatagtatatgattgtaaaactgtttgaccttccaaaaccttatattactgttttaaaagtaaaaatataattttaatgtcagaagaagcccagatgtcatctccttctgaagccttcatccactaagaaatattatggaaaagttttccagtggccttcaaattgatttagaatatatttttaatgatacagtggcatagatagtttgcagtgccagttttcaatacatcatttcactactaatgaaattaacaatattttaactgtcatgcattattttattaacaataataatattgttcttaatgagaacacatgaacaaagggaggggaacaacatacaccagggcgtgtggggagaggagggcaaggggagggaatttagtggactgatcaataggtgcagcaaaccaccatgtcacatgtatacctatgtaacaaacctgcactttctgcacatgtatcccggaacttaaagtaaaatttagaaaaaaagaaagaaaagaaaagaataataataatagtgttcttgctatttgtgctattttttttttagaataatatcaaaatctattattaacattgtttcttatggaaactcagcagcatatatcaaacattctctacctcctgttacttaacctttgcatattttaaataattgaattgatatgttctattgctcaacattcatttttagtaaaagtagagaaagtgaagattacagatatgctcagcagtaactgctgaaatccataagcacccaacttttctggaccaagttgctctgtgttcttactatatccagacaagtcctatttctggaaaatgtggttggacagggctgtaatgtttacaagtgtgtcaacatatttatattgtttgaaatggatttggagcaagtcaagtttttgaatatttaaggaacatatctacttgatttactaaccgtaagttatacaatttcatttttatttgtttttgcccttccagcttggggactttaaaattttgtccatacatgattgaaggaatgttcagccaaactttatctgaaatatttcctattaactcatatttatgtaaataataaaattagaagcatgcaaaatttacctttgggattatatcccataactggctcttgtcaaaattgacgttgttcataattttttgtaaaactattgagaaaattttttatagtgttccaattcattgtgatgaagagtagttgagagagaaataatgcactcctgtggtatgttttcttttccaaggatatatctaaagatatagataaataaacacatacatacacaactatatgtgtatatgtgtgttttatcattgtgtcttggaggtattggttaaaatggtttttaaataatagctacatttttgatagtttttaaatcaaaacatggaataatattcaattttgctgtagtattattacaatataatctattaactgtttgcactggataacagcctgtgggcttcatagaaactaagacaagttttctgactttattcatggctaccatttatttctggaaataatcttatttttgtttctgtaaatgcatttatacttcagttattcattatgtactaagtattacttagttgttgtatgtctaattaacatggattactgaattagttggtcaagagaaagagtagtgatgtgttaatagaatgaactagcctgatgttacctgaacttgaattctggcccaattaatatcaacaatatctcaatggtatattatcttaagtatcttcagaatccttacctttaaatcaggaattataattatagccacattatggggttactattatcaataagtctgtttaaactagtcactttgtaagcattcaatacatgttagtgatttctgactctaaattgcttgtggaataaatgctacccttgaagtgatatcagtcatgctaacaatggcaattcccttattttttatccagtgtcattctcactttttctgaataatataactttctggcaattctgaagacttagatttattttaccttagtccaaataggcattagaataagttgtcctcccaggcttggaatcagggaactgtcttctgagcaagtgcttgcttgacactaagaggatggatttatttctctggtggtgagatgacatttgatcatatttgtaacttttgaagattgcttttctctgggcatggtatgaactcaattacaactacatacagtatgtaaaggaaattgagagagggtcaagatcagaaataaggctactactcagtggtaggtaatatgcagaaacctgtatttgggcaaggggaccttacctggcctcccttgggccttctgttgcatggaatcaagagcagaaatggacatatagccttggcctgttaacccttagagttctcctctttctccactgccctcagtcaccagaagtcttctgaggatactaattgactccatcatgtacaattcctaaaacttgctgaatcatctgcttatgttgtatgtcagtgggagaaagaggccagtcatgcagtgcagatagcttcttcaaaaaggatagtgtatgtgacaggcaattttattgtaaaaacttgcttaataaaacaattcaaacagaatgaataagatagtattatatagtattatcctttgtccacattctcacactgaatttgcaaatcctgtcaggactgtttgttcagtacactctttatgggcttcagcctcttgacttaggggcatatagctgatgaagctgtagttggtcgataccaattatgtgaatgggatcaaaacaccaagaatgcaattttcaatttttctcattggactttaagtgttgttcttagtaggcatcattttcagattctttttctgcttggagaggttttaagcttgcacacattgaaatgtatgagagcaaagtgctacaaactagagcacagttacaaaatggtagtggctctgtctaccatttctaccaacacccttcggaggcagtctatctctattgttttccattgtttaccagcccctaatctgaccaatggtcctcaagcgcaacatcctagggctctggtgacgtggaagcattgggctgcggccctggaatgagaataaaggtgagaccagatccaggtatgtgctcgcagctccaaccagcttaaagacttgcagacagtaaatgacccgcaggtaagcagccttcccatctgcattgggaatccatcccaatgactctgagaacaggtgtttattcgctacagtaatgtgaaaacacaatgtaaataaaactaaacaaatacttaaatttcgtttggtttatcttctcccttatacttttgttttaggagaaatgctttcaagtaaaaaaaagtcatactcatctcaacaaaagattaaatgccatagaaaatatttactaattgatctgataatttttgaactaatataataaattatagacattaaaattttatcaaatttgagtgcagaaataataacctattttggccagaataccaatttgctttgtatttacataagattggaattatgcaggttacatgcttatgtttttttgatgttgaaatattaactaatacattgaacattatagaggatatagtttttttttaaatgtcatttatggaagagaattacatacaaaaggagagagggatgtgttttattacatatataaataatggctctgagatacaccatgctcaatcattttcataatccatttttccagtaatgttaagtaaataaaaacatatttcattagggtatatgtacacatcgcataattttatatagtttaaaactattcattgttatttgtagttcttatacataatacataacctgtttactatttaactgaaatgtgtaaaactgacaacaatgctatttttggattgtgagaagaaatttatttttgaagtattttttgagtgttgtactattttgtaaaacaacgagagaggaggaccgaaagcctcagaatgagccagcaatgctaagaattctttgtcaaaactcactttttaggaattcccaacctatttccaactgccttgcattaaatgccatttatatgccaatgattctaaatttattcagagctctcccttgcatttcaaacaaatacttttagtgccttctggatgattccatgtggatgcctaatgaatacctcaaatacaaccaacacaacatgtcctctgactctgcagacacacacctcagtcaagagatgttctgacttttcagttgctcttgcccaagaccttggagtcactcctgaaatgttttatcatgacccatatctgacacatcagcaaaacatatctggaaccactgttgtgacactggtgttagaaacaaatgcttgttccttggtaccaaaaagaagaaatagcacttgaacataaatttaattttctcggcaagacaatctttacttctatagaagggtgtgacttgcagatggagtaaaggtgagggcacacatggacagggagggtaaggggttcttattcctgatgtaggtagtccctactgctgtgtcattcccctattggctagggttggaccccacagtgtaagctaattcttattggctattttaaagagagcagggatacaagctggagtggcggggtgggtagtttggtgggaagggcagttacagaacaggtgactcaggatgattcaggtcagagcaggtgaccagaggtgactcaggtcaaagcaggtgaccaggggaacagatgtgaactactgattagagctggtgggaaagttgtgaaactagaagcaaggggtcaaagaggacaaggaagttaaactttaaaatagagaatcaaagaataagagagctgaacatactgacacactgattccttgaagagaaacttggagttcactatatctaacactggttatcctcagccctcaactgtgtcagtctcacatttcccacctggttcccactttgacctttgcctcctatcagtttccagtttgactccaagtaaaatacaaagttctcagggccctctgtaagatctgtcccccaacaccctcaggcatgccctatctgctctagtcttttgctacccacccaataactcagaccaattccactgttctgtttaggcatacacaagcctgaggtcctttgaatttgttgccttcctctccaaatagcttaaatagtttactcttttacttcacgcctattttcaaatgtcacctcctgaagatcatttttcctattatgctttataaatggcaatgccccaaaggatagtactccctactgcatttaaccagttttatcattgcctgacatattatgattaagcattttcttatttgctttatggtttgtcttggtcccactcaaaccaaagctccacgagggagagatgtcatctgttttgcttagtgctatgtccccacactggaacagcgcctggcacacagcaggcttgcaatccattttttggttgaatgcctactatggatatttctgtagcccccaaataaaacactttctgaaatagtagtgagtagtgagaactttgcttgaaaatatttccccgttgaaagttatttgtatttgcttaaaagaaagaaataactataggcatgtatggggtgggggtaaggggaagacagtatctaatgggactgggatggaatgaacattctttagtcctgagtcattctttagaagaggactcagaagccaggccaaagatgatatcatccatattaatgagcactaattgaacagtttggccaaaaacttcccctttatctgacaaaatgtgcaggactaattgaacacattttatgagaggttttgctgccagataccatttcccacaaagatctgcaatttttacatctccctaggcaagatactaatacagtatactagggtatataaataggagagcaatttcaagtgacacaagtattccctttatatcccatggtggccagatccatatgagtccattctgctactttatggcttttactacttgagggatttaggaaaagtggaataagttgcagtggagggacactaagataattaaatagctaaaacgtagcacctgtgaggaaggtccagtcatttgcttcatttgattttataaagagaaagctgaaaggtgatttcataattgtcctcaaggatataaaaggttacttttcaaaaagtggtgaccacctgtttttaatcacaattgaagaaagattaggaaaaaaattggtataagctgctatgtgaggataaagttttcaaaaaggaagactggaacattgaagaacagattctacatacaaattattaaagattaagaactgtaatttcattcttagtagacatttaagtgtgggtttgtttgaattattttttggaggcagggccaaatgaccaaccataattcctactgtttgtgaccctctgatatccccacttacataaacaagtagtatttccccctcactggatagctatttctctggaaaaccacatgctctctgcctgtgtgttttctaaacatgaatttgagaacgttttttattatgatacaattagtctcagagatagaatattagagttcaaatctggaagatgaatcttagaactattaatcctggtttggattaatctcactaagcaattttgaaagtaatctattcaacaatattacaagaaattaattttgttttgtgtgtctcttgtttgtttgcttttctggttctaggaatgctaatttatggtagtaaagcttctttctgtttcaataataatgtcttagggaaaattctgtctgatgtcaatcaaaaaaataatgaaaactgatttaagtatattaaattaaaaattcaagaatgcaaataaaatacaatgataaaaagggttttaatgataattacattctacatatgatctatccatattttaagaaattatcatataaaaaagtattttccctttgaagttgcacaacatttttctttttttttgtttttgtttttgttttttttttctttttttttattatactttatcttttagggtacatgtgctcattgtacaggttagttacatatgtatatatgtgccatgctggtgcgctgcacccactaactcgtcatctaccattaggcgtatctcccaatgctatccctcccccctccccccaccccaccacagtccccagagtgtgatattccccttcctgtgtccatgtgatctcattgttcaattttccatatgtgctacttacctttactcaaattcacctttttcttacttaaaaaaaaaatagagcttcacttctccaagcccagtggaaagctaaatctaagacttattaagttagtgaaggaaattaagccatgacgtgtagatagatttaacaaataaatcagtaaggatgctataaacaaaggggcatgttagaagaacaagagcatggttgtggtcaatgtattctctgcttatgacaaacataggaaaataaccttgcttttcctccaagagattggttaatgtatttgtttctgaatgaggtaaatgctagtgacatgagagacgctgctagaaagaactatgccatttaaactaccagtcctccagggtaataatggtgtccaggagtttatccattatctaccttatataagcccctttgcctccatagatttccaagcctaaaattgctaatctttgaatatgttttctaactctgataatacaaaaaactgtggatggtggttatattttttaaaaaacatattttacctgtaaatttcagaatctctgagttttcaatatttgaacttgtttgtcatttggtcttttcaaaccttaattttttcaaaggcagagtggaaaatgaaataatttccataaaaacatttcataatataaatcatattcttcaaatagaaaatattattattaacaggaacaataaatacatatctatagagatcagtatttgtatttatacagctattttaagctgtcactgaattcagacacttttgtgggcacacacacacacatacagcacatgatctctagagaatggaggaagagtcagatttatctatgtagtacacaattctggtgagcatgttttcatttcagtgttaatactgttagctaattgtgttaaagatgaagtcttcttttctctgccttatatatattgtattctaccatgcaatatcacactgtgttatagagacatgtgtgtgtgtgtgttcttgggtgcacgggtaccaaacatgtacgggattcagtgttagttagatatgctctagttttgtagtagtagtctatttcaattatggtaaatgttacaattattagtcacattatgagatattagaaatattatggactacttaatatgttcaagtcactttttctaagtgatatacatcaatcaattcttttaatattcacaggaacttaaggcaggtactatcaggcagtatcatctcctgttgaaaatgcctacactaattcttaacgagataaaaggagtggtcaaaattgccttcaaacttaagctgaatgtctccaaaactaatgtttataatttttaggccaagtattaatagcttctaaagcgggaaacttatcaatgtgtttgagacctatttccctcattagataaattaaattatagccaactttggtggattactataaagattaaactagagacagtatttgaagaatatgtcaatttatattagggattctttcctaagaagaaggaggaaatttaaacttgtattctcctttctttttctcaggtaaagcaactaaaactcagaaataaagaattaatttgtatatatgaatatttatttggttttaaaaataatttttaaaatatcccaaatgtaatgttttatttacaattatttaaaaatttatttaaaattaataattgtaaaaataagttactttttttcagtggttgaaaatgttttcaggtataaagtagttttatgcaatcaaagttgtcagcttgaaacagacaattataagtaatagaaatagactatgaaatagactattgtaagctttctggtaaccaaatagcaaaaattgcatgacctgcacaaaataaacatgaagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctgctcgggaggctgaggcaggagaatggcgtgaacccgggaagcggagcttgcagtgagccgagattgcgccactgcagtccgcagtccggcctgggcgacagagcgagactccgtctcaaaaaaaaaaaataaaataaacatgaaaacaattcaaaacatatgactatagaaaaccatgaaaccacaaagaaagacagcgagagatgaaaaatgaaaaaaaaatgaaataaacaaacaaaaaatcgcagaaaacaactaagtagcagtagtaaatccttaactatcaatactaatcttgagtagaaatgaattaaattctccaataaatgaatgaatggataaaaacaaaacctgactatatgctgattaaaatacatgtacctcccttttaaggacacacatggaagaaatcgaaaaagacatttcatgcaaatagaaattaaacagaatcagaggtagcaatacttgtattaaacaaagcagatgctgaatcaaaaactataaaaggagacaaggagcaacattatgtagtgataaagggatacgttctttttttattattataatttaagttttagggtacatgtgcacaacgtgcacgtttgttacatatgtatacatgtgccatgttggtgtgctgcacccgttaactcgtcattaagcattaggtatatcttgtaatgctatccctcccccctcgccccaccccacaacagtccatggtgtgtgatgttcctcttcctgtgtccatgtgttctcattgttcaattcccacccgggagtgagaacatacagtgtttggttttttgtccttgcgatattttgctgatattttacagtcccaccaatggtgtaaaagtgttcctatttctccacatcctctccagcacctgttgtttcctgactttttaatgatcgccattctcactggtgttagatggtatctcattgtggttttaatttgcatttctctgatggccaatgatgatgagcattttttcatgcgttttttggctgcataaatgtcttcttttgggaagtgtctgtccatatccttcacccactttttgatggggttgtttgtttttttcttgtaaatttgtttgagttcattgaagattctgtatattagccctttgtcagatgagtagattgcaaaaattttctcccattctctaggttgcctgttcactctgatggtagtttcttttgctgtgcagaagctctttagtttaattagatcccatttgtcaattttggcttttgttgccattgcttttggtattttagacatgaagtcctcgcccatgcctatgtcctgaatggtattgcctaggttttcttctagggtttttatggttttaggtctaacatttaagtctttaatccatcttgaattaattcttgtataaggtgtaaggaagggatccagattcagctttccacatatggctagccagttttcccagcaccatttattaaatagggaatcctttccccattgcttgtttttgtcaggtttgtcaaagatcagataattgtagatatgcggcattatttctgagggctctgttctgttccattggtctctatctctgttttggtaccagtaccatgctgttttggttactgtagccttgtagtatagtatgaagtcaggtagcgtgatgcctccagctttgttcttttggcttaggattgacttggcaatgcgggctattttttggttccatatgaactttaaagtagttttttccaattctgtgaagaaagtcattggtagcttgatggggatggcattgaatctataaattaccttggacagtatggccattttcacgatattgattcttcctacccatgagcatggaatgttctcccatttgtttgtatcctcttgtatttcattgagcagtggtttgtagttctccttgactaggtccttcacatcccttgtaaattggattcctaggtattttattctctttgaagcaattgtgaatgggaattcacttatgatttggctctctgtttgtctgttattggtgtataagaatgtttgtgaacattgattttgtatcctgagactttgctgaagttgcttatcagcttaaggagattttgggctgagacaatggggttttctagatatacaatcctgtagtctgcaaacagggacaacttgacttcctcttttcctaattgaatagcctttattttcttctcctgcctgattgccctggccagaacttccaacactatgttgaataggagtggtgagagagtgcatccctctcttgtccccattttcaaagggaatgcttgaagtttttgcccattcagtatattggctgtgggtttgtcatagatagctcttatttttttgagatacatcccatcaatacctagtttattgagagtttttagcatgaagcgttgttgaattttgtcaaaggccttttctgcatctattgagataatcatgtggtttttgtctttggttctgtttatatgctggattaaatttattgatttgcatatgttgaaccagccttgcatcccggggatgaagcccacttgatcatggtagataagctgtttgatgtgctgctggattcgttttgccagtattttactgaggatttttgcattgatgttcatcaaggatattggtctaaaattctcttttttcgttgtgtctctgccaggctttggtatcaggatgatgctggcctcataaaatgagttagggaggattccctctttttctattgattcggatagtttcagaaggaatggtaccagctcctctttgtacctctggtagaatacggctgtgaatccatttggtcctggacattttttggttggtaagctattgattattgcgtcaatttcagagcctgttattggtctattcagagattcaacttcttcctggtttagtcttgggaggatgtatgtgtcgaggaatttatccatttcttctagattttctgatttatttgcatagagatgtttgtagtattctctgatggtagtttgtatttctgtgggatcggtggtgatatcccctttatcattttttattgcgtctatttgattcttctcttttttcttctttattagtcttgctagcagtctatcaattttgttgatcttttcaaaaaaccggctcctggattcattaatttttgaaggtttttttgtgtctctatttccttcagttctgctctgatcttagttatttattgccttctgctagcttttgaatgtgtttgctcttgcttctctagttcttttaattgtgatgttagggtgtcaattttggatctttcctgctttctcttgtgggcatttagtgctataaaattccctctacacactggtttgaatgtgtcccagagtttctggtatgttgtgtctttgttctcgttgctttcaaagaacatctttatttctcccttcctttcattatttacccagtagtcattcaggagcaggttgttcattttccatgtagttgtgtggttttgagtgagtttcttaatcctgagttctagtttgattgcactgtggtctgagagacagtttgttatcatttctggtcttttgcatttgctaaggagtgttttacttccaactatgtggtcaattttggagtaggtgtggtgtggtgctgaaaagaatgtatattctgttgatttggtgtggcaagttctgcagatgtctattaggtctgcttggtgcagatctgagttcaattcctgggtatccttgttaactttctgtctcgttgatctgcctaatgttgacagtggggtgttaaagtctcccgttattattgtgtgggagtctaagtctctttgtaggtcactcaggacttgctttatgaatctgggtgctcctgtattgggtgcatatatatttaggatagttagctcttcttgttgaattgaaccttttaccattatgtaacggccttctttgtctcttttgatctttgttggtttaaagtttgttttatcagagactaggattgcaacccctgcctttttttgttttccatttgcttggtagatctccctccatccctttattttgagcctatgtgtgtctctgcacgtgagatgggtttcctgaatacagcacattggtgggtcttgactctttatccaatttgccagtctgtgtctttcaattggagcatttagcccatttacatttaaggttaatattgttatgtgtgtatttgatcctgtcattatgatgttagctggttattttgctcgttagttgatgcagtttcttcctagccttgatggtctttacaatttggcatatttttgcagtggctggtaccggttgttcctttccttgtttagtgcttccttcaagagctcttttagtgcaggcctggtggtgacaaagtctctcagcatttgtttgtctgtaaagtattttatttatccttcagttatgaagcttagtttggctggatatgaaattctgggttgaaaattcttttctttaagaatgttgaatattggtccccactctcttctggcttgtagagtttctgccgagagatcagctgttagtctgatgggcttccctttgtgggtaacccaacctttctctctggctgcccttaacattttttccttcatttcaactttggtgaatctgaaaattgtgtgtcttggagttgctcttcttaaggagtatctttgttacattctctgtatttcctgaatttgaatgttggcctgccttgctagattggggaagttctcctggataatatcctggagagtgttttccaacttggttccattctccctgtcactttcaggaacaccaatcagatgtagatttggtcttttcacatagtcccatgtttcttggaggctttgttcatttctttttattcttttttctctaaacttctcttctcacttcatttcattcatttcatcttccatcactgataccctttcttccagttgatctcatcagctactgaggcttctgcatttgtcacgtagctctcatgccttggttttcagctccatcaggttctttaaggacttctctgcattggttcttctagttatccatttgtctaattttttttcaaagcttttaacttctttgcctttgttttgaatttcctcctgtagctcggagtagtttgatcatttgaagccttcttctctcaactcgtcaaagtcattctccatccaactttgttccactgctggtgaggagctgcattcctttggaggaggagaggcgctctgatttttagggtttccagtttttctgctctattttttttcccatctttgtggttttatctacctttggtctttgatgatggtgacatacagatgggtttttggtgtggatgtcctttctatttgttagttttccttccagcagacaggacccttagctgcaggtctgttggagtttgctggaggtccactccagaccctgtttgcctgggtttcagcagcggtggctgcagaacagcggacattagtgaaccgcaaatgctgctgcctgatcgttcctctggaagttttgtctcagaggagtacctggccatgtgaggtatcggtccaaccctactggggggtgcctcccagttaggctacttgggggtcagggacccacttgaggaggcagtctgcccgttctcagatctcaagctgcattctgggagaacaactactctcttcaaagctgtcagagagggacatttaagtctgcagaggttactgctgtctttttgtttgtttgtgccctgcccccagaggcggagcctacagaggcaggcaggcctccttgagctgtggtaggctccacccagttccagcttcctggccacttcatttacctaatcaaactaacccggcaatggtggtgcccctccccaagccttgctgccaccttgcagattgatctcggactgctgtgttagcaatgagcaagactccgtgggcataggaccctctgagccaggtgcaggatataatctcctgatgtgccctttttttaagcccattggaaaagcgcagtattagggtgggagtgacccaattttccaggtgccgtctgtcacccctttctttgactaggaaagggaattccctgaccccttgcacttcccgggtgaggtgatgcctcgccctgcttcggcttgtgcacagtgcagggcacccactgtcctgcacctactatctggcactccccagtgagatgaacctggtacctcagttggaaatgcagaaatcacccgtcttctgcatcactcactctgggagctgtagaccggagctgttcctattcggcaatcttggctcctcccccgggataagttctttaagagtgtgtaacaattgtaaatatataaatgcacccaacagtaggacacctaaatatataaagccaatattaaaggacctgaaaagagaaatgaattgcaatataacaattatagaggcttcaatattggacagatcacccagacagaaaattaataaggaaatactggatttgaacaatgcgttagaccaaatgaacctcataacatttgtagaaccttccacttaacagcaacagaatacacattctgctcaagcacatatgggacattctctaggataaatcatttaagccacaagacaagtctcagcaaatttatgaagattaaaatcacatcaagtactttttcaacctcaataatatgaaactagaaatcaataacagtaaggattttataaattcacaaatatatgaatattaaacaacatgctcctgaacaaccaatgggtcaatgataaaattgaaagatacatttaaaaatttcttaagacaaatgaaaatgaaaacataacataccaaaacctatgggatacagaaaagcaaatcttatagggaagtttatatcaacaaccacctacattagaaaaggagaaagatttcatataagcaacctaatgttacacctcaagaaattagaaaagcaagaggaaacagtccaaaattattagaaggaagaaaataataaagaacataaataaacaaattagagactagaaaagaaagaccaaggaaatgaagtttttttttttgaaaaaatgtatcatattcacaacctttagctaaactaagaaaaaagataagagactcaaataaataaaaccagggattaaaaatgaaatattacatctgataccacagaaatacaaaggatcataaacaaatttatgaaaaagtatatgccaaaaaattggataacctagaagaaatgaatacattctgggacacatacaacctactaagagtaaatgctgaaaaaataaaaatgtgaagagaacaataatgagtgaggagactgaattagtaataagaagtctcccatcagagaaaatcccaaggcctgatggcctcactgttgaattctatcaaacattttaaaaagaactgatgccaattttctaccaattactccaaataattcatgagggaacacttccaaactctttttatgaggataacattaccctgataccaaaggcaaagacatcataagaaaagaaaattataggccaacacactttataaacataactgtgaaaatcctcaacataatactagccaaccaaattcaacaacacattaaaataatcatttaccatgatcaagtgggatttatccctggaatgcaaagatggttcaacatttgcaaattaataaatgggatacgccacattaatgaaatgaaggacaaatatcatataattattttataaaacacaaagcatttgacaaaattcaacattcttttataattaaaaaaaaaaaactcccaacagattagttataaaagaaatgtacttcaacacaataaaggccatatatgacaagccaaaagtcaacattattctcaacaaggaaaagttaaaagcatttcctgtaagacctgaaacaagacaagaatgcccactatcaccactcgtattcattatagtgttgaaggtccaagccagagaaattaggcaagaggaagaaataaatggcataaagactgaaaaagaaaatgctaaattgtccctgtttgcaggtgatatgatcttatatgtaaaaaaaaacccaagatccccccactcacacacacacacaaaaaaaaccgttaaaaatagaaacaaatttaggaaagttacaggatacaatatcaacacaaaaattagtagtgtttctttacattaacaaccaatgttttaaaaaaatcaaacaataccgtttataatagatacacaaaatgcttagcaatagactgtttctgacagtcaagtatagtttatttactgagtagataagccaaaatattaataattattcctaaatgaaggaattatgagtgacttttaatttttgtctgttttttatttcttatttatttatttatttatacttaggaagtaccagtgtatatttcttacatgcatatattgtgtagtggtgaagtgtgagcttctagtgcgcctattacccaaataggtaaatttttaatctttacccatattccaccctcttactctttgaagtcttcaatgtctattattccattctatatgtccaggcttacccattgtttacttcccattataagtaaggatctacagtatttgactttctatttctgagttatttcatttaggataacggcctccagttccatcaatattgctgcaaaagacataattgtattctttttaatggatgagtagtattgaattatatatacatatatgtatatatataatttttattattcatcacataggttgattccatatgtttgctattttgaatagtgctgtgataaacatatgagtgcaggtcatgttttgataaaatgatttcttttcctttggatatatacccagtagtggaattgctagattgaatagtagttctatttttatttctttgaggaatctccatattgttttccataaagtttgtaccaatttacatttccaccaacagtgtataagcatttccttttctctatatcttcaccaaatctgttattttatgacattttagtaatagccattctgactgggataagatggtatctcactgtggcttaaatttgaatttatcttatgattggtgatgttgagcattttttcaaatgtctgatggtcacttgtatgttttcttttgacaaaatgtctgttcatgtcctttgcccactttttaatggggttatttgttttcttcttgttgagttgtctgagttcctcatagattctggatattagccctctcttagttgcatggcttgaaaatatttttttctcattcttaggttgtatatttactttgtcagttatttcttttgctttgcagaagtttttaatttaattaagtcctatgtttgctttgaggacttggtcataaaatctttgcctaggccaatgtccagaagacatccctaggttttcttctaggatattaatagtttcgaatcttatggtctttaattcatcttgagttaattttttatatggtgattgataggagtctggtttcattttctgcatatggccatccaattttcctagcaccatttatgaaataagatgtcctttacccagtgtatattcttgttgactttgacaaagttcacttggctgtggcatcacttgactgatggctttatttctgggatctctcttctgttccattgatctatttgtctgtttttatgccagtaccatgctattttgcttactatagacatctagtattatttgaagtcaggtaatgtgatgcctccagctttgttatttttgtttatgattgctttggctaatttggggtcttttggggttccatatcaattttagaatttattttctaatctgtgaaatatgacattggtactttgatagacattgcattgaaattgtaaattgttttgggaaatatggccattttaacaatattaattctattgatccataagtatgagctgttttgtcatatgtttgtgtcaactataatttcttttatcagtgttttgcagtttttctggtagagctcttttacctccttgcttaaatgtatttccgggtttttttggaagttattataaataagattgccctcctttcaactgcattattgttgctgtgtagaaaagctactgatttttgtatgttaattttgtattgtgaaactttattgaatttattcatcgaaaataaaagttttttggtgtagtcttcagattttttgagatacatgattatatcatcagcaaacaaggacaattgactttctgttttccaatgtggatgactttggtttatttctcttgcctaattgttctggctagtactttattactatgttaaataggagtggtaagagtggacaaccttctcaaagtccagttcttatggggaatactttcaacttttccattttcagtatgatgttgactgtgggtttgtcatatatgacctttattattttgaggtatgttccttctatgcttcatttgttgagggttttgagcttgtgctcttatgaagcgatgttgaattttaaaaaattctttttctgtgtctattgagatgatcatatgatttttggccttaattctgtttaggtaatgtatgacatttatttgtgtgcatatgttgaatcattcttgcatctctggtgtaaaatcaagttggtcatgatgtaatatctttttgatgtgttggatttagtttgttgagaatttattgataatttttatatctgtgttaattagggatataggtctgtagttttattttttgttattgtgtttctggctgactttggtgtcagggtgatacaggatttgtataataagttagggagaaattccttttcagttttttgaaaagtttcaggagtattggcaccagttcttccttgtacatttgctagaatttggttgtggatccatctgttcctgggattttctttgttgggagacttttcgtagttgggagatttttttattggattttaaatccaatgttgttatttctctattcatggtttttatttcttcctgattcaatcttaggaagtagtaagttttcaggaatttgtccatttcctctaggttttctagtttgtgagcatataagcataagggtgtggactcagtactgctaccttggccaagaggagtgagatgtgattctctctcatgcccccatttttggtggggctcaccaccttctcaactttgtcagtaggtttggctgttcacttagttagtgcagtttacttctagttgtcaacacaagctgccccaggccttaggagtcactgcacagcccaacactatgcctcccaaacaaatcccctcctgtactggtgggggaagggggtgaagtgaaagatggggtgagcctggttccagcatgccaatggctggagcccatgccatacttgattctcggttctggctgtgggaacctcttccctgcttgagcaccagatccccaggatactgttagagcctctttaatgacaaaggctgccactgctgctagttttcaggactgtgcacagcttgcaaagagctaggatcaagaatggtgttctgttgtaggttccaaggtctcgggaagtgcatgggacacttcccagagcaggtacttcttacagtctcccagccacatcccaaggtagatctagggcttagaaaagtcatggtgctctaccgtggcctgaattatatgattctatagtgggaaattggaccacagaaagatactcactcaccctctcccatattgggaatttactctcttctcattttcagccagtcccacagccacacaggctgactgttcttctttttctggtcagattttggagtttcttcgtgtgttactgttgaactcctgtgttctctcttggataatatgtttgtaaacaaaaaagttactgaggtggatcttaatcaattagagatttattttgccaaggttgagaacatgcctgggaaaaagaaacacaaatcacaaggagatctgtaccctgtgcttttttttaaaaagggttctgggaacttcaatatttaacagggaaaaagcaagcaggaagaggaagaaagaaaaaaagtctgggtaggcaatgagataagtggtcacattcttgtgaggatcttactaatgagcagaaaagctacattttacataaagtaaacatgaaattacagctttttgggaatgaaaggaaggcagttttttcatgactaactacctaaacttagccctttggtatagtgagtttggggtcccaatatttgattttgctttcatatgtgcaaagtgtgattgtctacacaccattgtcattcttctaagtggatgaagtaccctggaaaagcatctagtcagccatcttgaaaaaaaaacctgttgtttctttgtaatattgctttataaatctgagagaacttggaacaaatctaacaaaatagaagatacttctggagaagtgagaaaattgagaaaaatgcaactgatgagttcttgatatgtttagctattattattatcattactattattaaatgatactttccagttggcaaaaaagtattctggaggctattctttctactggggcataagtcaaactatgacaaaagagaaatgcatgcagagagcaagccatagaaggcaagttaggaaatgatacgaatatttatctgtatttattttattgaatcaatactgacaacaaaaatttccaacattaagtacttccaagtattagatactaagcaaagaattaaatatagtatcttatttaatcatcagatcaattaattatttccactttagtgatgagtgaaggaagctatatatatggtaatcaacttgacaaggattacctattaataaataaaagagaggagattcaaatcaagacagaattctgaagctagaacttttgttcttatcaccttataacagctcctgcatgtgtgttagagagagaatgagggtgagaaagaggaatatatacattcttatttaaacctatgtggataatcgtgtaaatactccttattatactaatacttctagtcaatgccagtctctaagagtatcttatttagtttttcagttagttatatatatattattacttgcatataacttgataatgactgcaaccgtaaaggaacacaatcttttgaaatgttataggcagcaaaggtagaaactctagtaaaagaaatctagtgtcaatgattttagatgattatgttgaaagtagatctttaaaatgattgagctatagtcacttttcactaaatttctgataaaggaacccctgctttttccaaagtttctcctcctcccacccatccactcttagccatctaaagcttagagtctatgctgcccccttctcacttaactctccaatatcttttcctggcaggtgcattctatgaatttcttagcaggatcacctggtctttttcaggcttgcaccaggttgctcttgcatttgtctttaagtccttgatggtactacagtctctccctacaatacaactttccccctcctactttccctcaagatgatttatcgttccttattctgcttccttagcatgttacctctatagcactgtcatatgctcgttattttaacatatttctctccctcactaaaatgagacctgggtgctcagatgccatttgcagtgtgagtcagttcatgagaagtatattataaataacaacaggaaatggcaagaagttttcagagatgctgaaactatatttgcagagttgattagaggatgctttgtctgagagagagtcacgacttgggtaatataacagaagatcttaaattgagttttaaaagagcaaaggagtaaagttttgctaagagaatagaaaatcttacatgaagtccattttaagatcctattgctacatgtgatttatgaaaaggaaaaaataacaaaattttctgactaataatgacattagataatattttttattataaggaaaatgaagggcaatttaataaaccataaaattggcaaggtttctggaaactgcaacgtttagttatagatttttgccaatttatcaatttaaaaagctaaggtagatgttgaaatatctgcagtataaagagagggcatactaaaatttttgctatagtagcttgtcattatactgtgttcaagtccaaaatttataaccagatcaatcatcccatgtccttccctagcttcagctctcaatgtttctgcctccttttctttgaatttctgaaatgcctgacttggccccagccagtcccatccactctctggaaagaacaccctttttctatactttatctttgatattctactcgttttcagccactgtttaaaatttacttcctagagaacatttctctagcttttcaatctattgtgatataatacctttttcttcctcttcttcttcttcttcttcttcttcttcttcgtgttcctcttcctcttcttcttcctcctctttttcttcctcttcttcttcttccttcttcttcttcttctttgccttcctcttcctcttcatcttcctctttttcttcttctttttctttttcttctccttcttctccttcttcttcttcttctttctcttcctcttcctcctcctcctcctcttcttcttcttcttcttctcctcctcctcctcctcctccttctccctcttcttcttcctctttttgagatggagtttccctctggttgcccacgctggaatgcagtggcacagtcttggctcactgcaacctcctcatcctaggttcaagtgattctcctgcctcagactcccacgtagctggaattacagggatgcaccaccatgtccggctaatttttgtatttttattagaaatggggtttcaccatgtgggacagtctggtctggaactccccaacctcaagtgatctgcccacctcggcctcccaaattgctgggattactgacatgagccactgcgcccagcctcttattttttttataatggcatttacaataatttgtactaatatatttacttgtgtagttattatctctcattgttccctccatagatattataaccccaaaactactaaaaagtatttataatttatcattagattgtactctcaaacatattatgttttcatttttttctcccttcagacagagtaggaaaatcaataagcacagcatttatcatccttttagctttctgagcatctactggcagcaagggtcagagctaaattctacaaccctggaagtaaatgccttccattagctctcttccagcaattataagaatgcaagcaggaaacaatgaaaatagttattattttttaaacatttgccaaagcagagaattccatctaacattttgggtgtttaataatgatacacttacatccctccttatgagaaatgattacagataccagtgattaaccctttgacaattttcagtacactgcatagatatagcatatatacagtcatttaataactgagatatatttcaggaaatgcctctcagttagatggttccactgttgtacaaacaccacagaatttgcttgcacaacctgagacagcataacgtactgcacagcgaggttatacagtacagcctatttctcctaggttacacacctgtatagcatatgactgtattgaatactgtaggcaaaagtaacataatggtaagtagttgtttaaacacatctacacatagaaaaagtaaagtaaaagtacagtctaaaagatttaaaaaaaaaatgatacacagatacagggcacttaccatgaatggagtttgcagaatggtagttgctctgggtgagtcaatgaatgagtgatgagtaaatgtgaaggcctaggatgttactatacagcactatagactttataaatactgagcacttagactacactacatttataagaagtatttttttctgcaataataaactaagcttagcttactgtaacattttttactttacaaagttaattttttcaactttggccttttttgtagaagtgcttagcttaaaacacaaacacattatgtagctgtacaaaattattctatatccttattctctacattttttttctacttttaaatttacaaattacttttttatttttggctttttaaaatttttataaaaaataagacagaaacacacacattaaccttggcctgcatatagtcaggatgagttccatcatcacatcttgtcccactggaaggtcttcaggggcaataacacgcatggagctgtcatctcttatgataatgatgccgtcttctggataccttctgaaggaactgcttgagcctgttttatagttaactatatttttaataaatagaaggagtacactaaaaaaataggagtacagtaaatacagtaatatttactgtattactataatacagtaaatacataaaccagtaacatattctttcttatcatcattattattatgtagcatacatcataatcgtatgtgctagacttacacagctgtcagcacagcaggtttgtttacaccagcatgaccacaaacacaagagtaatgcattgctctatgacattacaacggctatgacattgctaggggataggaatttttcagctcccttataaccttataggatcaccgtcgcatatgcagttcatcattaacccaaacatccttatgcggcacatgactgtatttaaaatgctatatctgacatgttgcattgggttactctgtttcataaattatttgcttcacttttttttctcatgttaatgtctcttaaattggaatatatgtaaatttgtgaacacttcagttgaaaacttctggtaagaccaagaaattgccagcatcaaagtcgtttttttgatacaatgaaatacagttacacaagtaaggtaaataatgcgtttttttttaagcaatattattgctgtagacaaattagactcattttctttttcatttctcatggagaagaatattttggtttgcttataaagttccttaaaatttacaaacatgttcacaagcattatttaatttcaacatcataacagttatgtaaggaagggaagagatagtgtgtcacccctttgtagagtaataaaccaagtcttgtatgttaaatgctttggtggttatattgttagtaagagatgaagccagaaaccctaacttctattttatggacatgcttcagtgtaaagacagagaagtcatgtgttggggctttgaagcccggagttctggtataatgtctaatgaagacttggtgaattcgcagagtgttgtctttttacctgtggcttctgcaccttggtccagtcaggaatggccaggttagcaatgtgaagtgatgtgtgccagcctgtgtaactccaggttttcaccaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacaggtgagagtctgtgggactgcaggatgtgtggctccctcagatgcatgaccacttccctagagttctaatatcattccaaagtagtgtaaaaatacagttctgggaatcttgacctcatatacattctataattagccatttttgtttagtgactagtaatacagctctgaataaaattttaatttttccacgacttgatctttccaggctatttcctactactaattaaaaatatatttctaattttaattagacattactctgacttaaatctaatatagaaaatactctgatttaatgaattgttgacaaggtcacttcctgttctccaaatatgacctcctaatttccagcctgttggcgtcatttactcacaatgctctttccctttgcctccatccttcaaagccacacagagtttttgagactttttatcaaaggtcatatcatccaggaacatgtccctgatttccagtccaccctgcctaatgcttgccaatactccttctacaactatcctgttcaaacaactcttcttctcacttttgaacacaatataatgtacttttctggtttttttacagataagaaaacacaaactaatcaattgtattcatactactcatgaaaagcaattacatttttacatgaagtcattaacacatacaacaataaaaatcataaaagtaatacatctgattagaaatacaatataggaaatagattttaaaatagtgtagtttagtgataaaatttatactgtgttttctacttatttatagcagcatctataagattcttctatttatttgtcttttttttttaaggattgcacacactcagtctgttttgtattgcagtgacatgtgcttgttattccctgcactaaattataggttgtttggaattatcttatcatgtgccaaccaaagtccagtgcattttgcacatcatgagtattcaacagatatttattgaactttgtttcttaagtgtgaagttatacactagatcaaactttatagagccctcagcttctgtcttcacaagaccattgaacaaaacagcctcccaaagttggtcctgtggctgacctcaaacagacctgtggacaaattaaaaggttttcatgcgcttgccacatgcaaatagatccatagagcaaggacctaaatacacacatggacacttaattttgaaaacaaatgtggtgaataatctagcattgactatactggaatgtttgcgtaaaacaggattgttggatacatatattttgaacatgttgaactgatttctattttctgactacaaacctctgtaatcaacacatcaagttgtaccagtatgacattacaatcaggggaagaggacagaaagaaaactccaattatagtttttttaattgttcagttgactcttttcaataactctgcttttatcttcatgcacctaaaaagtcttaaatagccaaaaaatagtttccacaattagaacctcaattcaaaaaaatagatattatatcaaaaatggaaacaaaactatattaaatatgattttattctgagtcaagatccaagaccatttaaagcattaaaatataatttaatggaatgtaagttgacagttttgttattgaaatttatatttttaggtttctaaaattattatttctctacaatagtccacttcgcttggaaacagctacatggtaattttaacattttggttccaatttagtattttattttaagtctcctgatatttataaattagatagagataaaatctttgaatctgggctttgtattctgtaaactgatattcagtgaaatacattggcctatttccttacccattcacaatgccagtgtaagataaacatcagaagtgaaaggtaaaacatttaatgtctttttagcttttagttgttctacagattttataactcttatttatttaccacataagaaatcaatgaacacctttgtagtattactttcaaatttaaagtatgtgaatatatttacatgaagaaccttaacacgtttttcttctatattcttaatttatcacttccagtaaagttgatagggaattaaataaagaaggaatataagttctatcgtaaaacaagcagaaagaaaaaaattaatgaattgactttcaaagtgttcctcatttaaacttccttaaaaaggataatttatgtattgatttttctctgtataatttgtttttaaggaaacaaattaaacaacaaattaaatatttcaatattaaacatattaactatacgcatgatatgctattaatattataaatgatagaacttgagtctgtatataaattgagacttcaatgagtctcaatttatagcacatctatttgtttcaatttcatgattattgagaaaatctaatttaatttgtaatgctgaacataataaaaaaattttaatacactgcaccgaatttattttcacctgacattttcttgtttaaatgacagtgcttgaaataagcaaaccattatgtctaaattaggagaaaattttatggccttaaacattccttaatgttgataatagttttaataaagtgctaataggtggatgtaagcatgcacaatgcttatgtattaaacaaatataattactcctgaaaatggacttttgaggcccattaagtatgttctttagtctgctttttttaaaaaaatgtaactctaaaagaataattttgcattattataatttttctatgctaataaggcttaaacacatgaatgtaatttttggtgaaggcaactcgatgtatttagtcatgattacattcagaatgggattcaattaatgtagttttatacacagtactataaaaacaaatacaatgcaaggataggtgttaaaaatttgcttcagataaacttctcttcctttttttcttctctctctttgtctctatttctctctcatcttgtacatggatcacaaatatttttcatgattggaatatcccactacgatttaaaattaaatgcaaataaaactggcttatagatgtaacaatacatcatgtcgtatataaaccttaagtttttatttcatatttgatttatatcctgttttctttatatttcagtatccgtatttactatgaaaaattaggctgggcacagtggctcacgcctgtaatcccagcactttgggaggccgaggcgggtggatcacgaggtcaggcgttcgagaccagcccagccaagatggtgaaaccccgtctctactaaaaatacaaaaattagccaggcacggtggcgggcgactgtaatgccagttactcaggagaccgagggaagagcatttattgaacccaacagacagaggttgcagtgagccgacaccgcaccactacgctctagcctgggcaacagagcaagactctgtttcaaaaaaaaaaaccccaaacaagaaaaattataatattatctgatctcattgtgaaaagtaattacttgttgatttttaaagaattatctgtagttataaacaaataaattggaaagtggtaaatatctgtaggaatatctcgtgcaatatcgaagaacagagtaagactgttaagatcaagatctattcttttggcttggttactgaatctgtatttgtgtgcatgagaatgtggtttaataatatccatgaaattgatatcctgagaattcaagacagtgctatttaacaatagttctcttttagtttaatgaaaatggttggctacagtaaataacaacttaacataaacttgcctacacctaaaactttttatattatataccacctttattgtcaacacagcaaagacagacagtgtagcacaatgtacagacaaaactagagggagcaggattggaaactcggcggggcatacaccttggcaagttaaataaaacccaacactctcagcttctgtttcattaacattaaaatgttgataatactcccttctttatacaattattgttaatattaaattagatattgtatgaagtacttattgcagaagctgtaacatagttcataatattgatattgcatcaataacatgaaaagtaacaatactttctgttctacctagtgcaagacctatgcatgtgtgctagaaagtcatctaatgggactcacaattgatttcagcacaggatttatctgctttgatgctgcaacaaaggtaatgtgttcaggtcagctctgagaaatatgctgcaaacattctaattgaagaatgatttaaatgcctcataactcctttcagcattttaattgtaatcgtgtcaaatttaagatcttcgtttttgttaatggaagataaattatgcttcgatctgaaaaaaagtttgaatttttaataaaacatatgtagtaccacaaaactataactatgtgaaagtatttatttataagtctatctatgtatgtatctatctatcaatcatttccctgttttttaaagatatgactttataattgaagggacattttcttccccaaaaagcagtttttaaaaaacatgtttctttatactttacctgcatcaacttctgcaatacaaaaagaaagaaaacatgttgtttttttaaaaaaaattatagctgacatgttagaattattgaatggtgaaaatttaaagtttagtttctagccagggagtaggacttttataaacacttgacttaataaggattatgcactatgaggtgctcttttcccaaagtgtacatctctgggagtgatgcacattgaatgacagagggtgcctactcagccagtcatacctaaaaaaatccaattttgattattatggaatgacaaatgacaaagccaaagcattgcacattattatcattatttttaattggaagcgatcttaaagctcaactgatccccattcaactgctaatctccttctagtcactgctacagtttgtgacttggaactgttgtccccatggaagacatcctcttccctctcattgaggatctcagttccttagatccattccatttcctccttcatcaaagtatggcttgggtataaattgatttgttccttctcactaattttaaggattcatgagtaatcctttaccagaacacacatattttatctagaaattaagttttgtgtaggattttctaaagcaaatggcaacaaaataaaacagtgatacgaatgtgtaagaaagatggagtgtaggaggcagtgggggttcttgagttgggaaagatgaatgtctaatggtgggatccaggtaggatgccgccctgtgttcattcaccttgtgaatcttcatgactcagcagttggcattgtcctgcaaaatctcacattacttaaacatatagttatttttattttaacatggtaaaattagacagcacacatttgctggtcagatttggccatctaatgtgttgccttcacatcatgacaaaggaatactttgtgaataaggaattttaaatgccaatgactcttgaaaactttcaaatgaggctgccataaactattcctattactaaagttttttttattaaaatgttcatcaaatcaagataggctcctgagtattaaattaatttgataaattaattgaattattaaattatcgattaaatgagtaataagttaattttataaataaatttagaaacaaatttcactaactagaaaagtcaaagtctgattttaaaaagaaaacgctattgccagaattgtcaccaaactctagtacacgaatgtataagaatcttacattagcgaatgagaaaaataaaattcacatgaatatatttctgagtatgcgaatctattctgagtttattttaaagctagcataatacagacctatgtcagtgtcctgttggctctgtataataagggagaaaatcatgacaccaatgtcctatctgacattcctgtctacttctgctgggtgttctgggaacgagtgcgtagtcaggagtgtctaagtgaatgattatgatgccatccagagaaaacagtttagtaggaaatgagaatttaatcagtccaagcttgatactcaaggaaagcaccagaggccttcaggaatagtagtcactgttctattttctgattctttcattggaagcatctaacttcaaggtaatctcagaattgggaaaggctaaaaggaatctacacattaatcaagaaggttatattatccatcactgattatacttggagaatgaaagtaggagctattaatagttatgtcagacataaggaggaggacaagcataaatggagattcctgggcaacccactgagctgggctgactgcaagaaacttgcaccccttcatcagatgaggctggaagttatttttaaatatgataaaaaggtaattgttacatacaaatcaaaacatgctttgtctaatgttttattaaaataaataatatctagttattttctatctattttttctaagtaatatgaatgtgaaaaatatctttaagactatatgtccaagagtttttgaatgtttggattcaggagagtttaccctttagctgaacatgctttgtccttctgcacttcatcttgatcaagtcctccaactttgaagttactacagaagcaaaccaaaggtcttgaaataaagaagagattccaggaaaggggtggactctattctgggtcattatttgagctccatataaagcaaatagtgtattcttaatacatcagtgaaggaaagaattgctgcatctctcttattgcagggaatgagagtcggcatgattttagattacactggtatgctaaacgtttggatatagagggatgtctgggaatgtcgagctaattctcattacttaccacctgtgcttggaagttcccagagtaaacgattacccttgacttgccagagcataagacgtattaaatagcattctgttccctatacttacatttacattagtagcatatcaagaggtgatacattcttcagttcccttactgttgctgagtgattccctccctaattcattactgtacagctcagcttgttctttgtaattctcttccttattaaaatgtagcattttcactgttagagaagggtattattattattatgtcaaagtataatgttaaccatacttaaataatttacatagctaaaagcataatcttgttgccattatattcttttaaaaatgtatatgtgcattaattaattttatatagtgatagagttcctagttaaacagaaacctcatcagtggcatctacaaaacactcatttaatttgtgaataaatcttcactgaatgcctgctgtctcttgagagacatgggagggcatacacatcagtcttcacagacgtttccttgaagtggagacaaggaggatgaaactatccagacagatatctgtaagtgaggatggacatggaatttgagggaagaggagatgagaaatcatgtctgtgggtatctaagagccagatttgaaaaaaggtccagttaagaaattggaagtgattctaagaacagaggaatacctttagggtttgagacaaaggaaagaaatgatcagatgtgtgtttgagaatcgaaaactagtggaataatgtacgactgaaattaagacaatctgggcaaaacccagattccaaatgtgtttttagattctttttcttattttttattttttattacactttaagttcttggatacatgtgcaaaacatgcatgtttgttacataggtatatatgtgccatggtggtttgctgtatccatcaacccgtcatctaggttttaacccccacctgcattaggtatttgacctaatgttatccctccccatatccccacccctcaacaggccccagtgtgtgatgtttccctccttgtgtctacctgttctcattgttcaactcccacttatgagcaagaacatgtgttgtttggttttctgttcctgtcttagtttgctgggaatgatggttttcagcttcatccatgtccccgcaaaggacatgaactcatccttttttatggctgcatatactccatggtgtatatgtgccacattttcttgatccagtctatcattgatgggcgtctagtttggttccaagtctttgctattgtaaatagtgctgcaataaacatacgtgtgcatgtgtctttataggagaatttataatcctttgggtatatacccagtaatgggattgctgggtcagatggtatttctggttctaggtccttgaggaatcaccacactgtcttccacaatggttgaactaatttacactccccaccaacagtataaaagtattcctatttctccacatcctcgccagcatctgttgtttcctgacttttcaatgatccccattctaactggtgtgacatggtatcacgttgtggttttgatttgtatttctctgatgaccagtgatgatgagctttttttcatatgtttgttgcctacataaatgtcttcttttgagaagtgtctgttcatatccttcatccactttttgatggggttgtttgtttttttctctcaaatttgtttaagttccttgtagattctggatattagatctttctcagatggatagattacaaaaattttctcccattctataggttgcctgttcactctgatgatagtttcttttgctgtgcagaagctctttagtttaatgagatcccatttgtcaagcttggcttttgttgtaattgcttttggtgttttagtcatgaagtctttgcccatgtctgcgtcctggatggaattgcctaggttttcttctagagtttttatggttttcagtcttatatttaagtcttacgtttaagtctttaatccatcttgagttaatttttatataaggtataaggaaggggtccagtttcagtttcatgcatatggctagccagttttcccagcaccatatattaaatagggaatcctggctgggtgtggtggctcacatctgtaattccagcactttggaaggccagggcgggcggaacatgaggtcaagagtttaagaccagcatgaccaacataatgaaaccttgcctctactaaaaatacaaaaaattagctggatgtggtggcaggcacctgtaatcccagctactcaggaggctgaggcaggagaattgcttgaacccaggagacagaggttgccatgagtggacatcgcaccactgcactccagcctgggtgacagtgtgagactccatttcaaaaaaaaaaaaaaaaaaaggtggggggagggaatccttttcttattgcttgtttttgtcagatttgtcaaagatcaaatgactgtagatgtgtggtgttatttctgatccctctgttctcttccattggtctataaatctgttttggtaccagtaaccatgctgacttggttactgtagcctagtagtatagtttgaagtcaggtagcacgatgcctccagctttgttctttttggttaggattgtcttggctatatgggctcttttttggttccctatgaaatttgacctcttcaaggagaactacaaactgctgctcaaggaaataagagaggacacaaacaaatgaaaaaaaaaaattccatgttcatggataggaagaatcaatatcatgaaaatggccataaggtccaaagtgatttatagattcattgctattcccatcaagctacccttgactttcttcacagaatcagatttcagatttttgaaatctgtcctccactgggcatttgccactctatcacattcctgagaaaaaaatacatgcatggatgacaaagtcaaagaataacactatgaattgagggaggaaaatgatcagagtgtaacctgagaacaaagagacatcagtacaattgaaagttaacgttccaggaggtgggtgtggagaggaaagctggagaaacagattgggccacatgatcaaggtccagcacaggctcaaccacaatctaatttacacagtggaaagaccattctagctgaggtacagcttgcatcaagcaggtgggggcaatacttaatgggtgcttatgttttccctcaatgactcattatagaataattttgaactttggttttgtaaaaaccaaaaccaaaaacaacaacaaaaacaaaaaccgtaaaaggtagatacttgttatgggcacctccattttatgtttttgttttcgctttacaaaattccatgattctaaaaaagtttgaaagttattctttatataataagtatgggcgtccaacaaataacacctgagtgttagtagttaaaataagaatgaaggcattggaatcccacacctgagacctagcatttactcctcctgctgcaactcgggagtcacagggctgcacgggatgtcactgtagcacaaagaatattcatactatgtaaatatccattgtgattattagaacatcataaatttgactcttaaacatgggtaagagtaaaagacagcattactcatatcattgctggtctctagaatactaggtcccccaaattgttatagtctgattgcttttattattatttaatgttttaatagttgaaattgagaatggctatgatagaatacttataaaggcttctttacttcaatttatttaagagccagtactgacacatagcttgttaaaaacattttttggaaatcaagattggttaacagatctatgaagataataaatatgaagtaaaaggaaacagtcgtaagaatgagctctatcacaggttataagctactgtatactattatataatgattttatggtttattttctctttatctcctttattagccttaattgaatatacattaaaagcattgttatggaggatgtttgttaaaacccactcacatgtatattgaccttcattttgcaaacttacattctgagaattaagaggcaatcaacgtaatcttagctgaaatcacttcattctggtttttcatattttttctacaaaattagaggacttaattattttccaaaataattatgatttacaattaaattcactgttaacacattaacattttaagttcatgaaataccttaatctttctaatccacttaatcctttaaatcgacactgatttctagaatctttcaaggtaaaatttgaattgaagttaatatggcccttttaatttttaaaaatctttgatatggctttgataaactgaaggagctctgagctactgtttctcccaaaggtgtatgaccctcatgtacacacatgtgcacacatacacacactttattacacatctttaggctttttatataaagcatttatatgatcataatatgaattccatagcttaaacttctcaacatagaattaaccttttatttcttaaattttatgttattattccataatctttcaattatttcacatcaaagacagttactaaaaatattaaaaaaattgaaacatcaaaatgaattctttcttgaaatgtctcctgtgtaagtagaaatcttcactatacaagttataatatagttctgacaatattcacataaatcttagcattttaaaattatatatatattttttctttccaattgtgttacagctcaacaatacaaagagctgtttgatgtaatttttatgttcttcttcagataaattatttcttctttgcttttagggaaatgaagaacattgtatttattgcaaaacgaactcagacatttagggaaactctcaggtacttgtttcctaatcttcaagtatttcaaagatagccctaaagtaaatattcaaaaaaatttaaacaaaaaagtattttgaatgacattcaaaaaaacccaacttttcatgcaatatgttattgtgtaatatgaaaaataaaattccctgcctttcttattctttttttttttctttttgaaacggagtctcacactgtcgcccaggctggagtgcagtggcgcgatctcagctcactgcaagctccacctcccgggttcacgccattctcctgcctcagcctcctgagtaactgggactacaggggcccgccaccatgcccggctaattttttttttgcatttttagtggagactaagtttcaccgtgttagctaggatggactcgatctcctgacctcgtgatccgcctgcctcagcctcccaaaatgctgggattacaggcgtgagccaccgcgcccagctcttactcatttcttgatatacaaggacattatagagcattgtgaaaattaacacataattcactgctatgtttataattcaaatatagaaaaaacaaaatcaagaaagattcaaaaggtctttggctaatatatacttttcatacccttaaattttatgtcttgttttccttctccttaaatctttacttttttattctttctttctgtggcttctgatatattttatttttttctggattaatgtttttatgattaagaataactgacttcaaacttttctcatcgtattttagtttacctttgcttaaattatcatttttgatttccataaaagttttgtaactcaaagtattatccttcaaacctgcatgaattgaatgggaatgatataactttgcttttccttacagcgttattctaaaattaaatgagatagcatgttaaaaataataaactgtaaaacataaggtagagattctgaaacatctgagcattatttccagctagcccatatttcaatagatcttgtctcaaccacaacatatcctttcatctataactagaattttatcatgctttttctttctgtttcaaattcctcagaacacatcagggagttgcttctgcaaatcatacagacacagtgagcctcattttcttcatctctaaaatggatatcttaataacacttttctcccaggcttatggtaaagtgtaagcaagaaaatgtgtgtgaagtgttttgcacagtgagacttgcatgatgaacccttagaaagagatgaacatttctgcccctcacacactgtgggatagtcccacccactgcagtacatgagtaccagcgaccctttgctactgtgctaccatcctcaagatgtcgaaggggcactgtgttttctgtaagtcttgatcaaccagtcagcagagttaatgtctgttacatttcagtccttagggtttgtgcttttggaggtctctgtccttttagcccaatgaagattgatgttgaacaagtagtcgtgagtttaaatggttcttagcaaagagagttcaggataacctggaagctgcaaactagattaatgggccattagcaatagttggaaaaaaatacatttcacttgagaatttgtaggtcctgggtgtctaagtaggcacacggtgaaggaagattgaaaggcaagtgtgaaatccctgagacttgacagaacactgacagaggaggaggaaaattaggggttgggaagggcacacaaaagtaaaatagtcaggcaccaaatctgaggaactttggacttcatgttgaagagttggcacttacatcagcagtggcccaagtttgccatgtaacgcataatgactatgcatcactgccttacgaaagtaaacatttgtttctcgtgcttctgtgggattcagaagattgatctggacaggctaatttatacggctgcagttcggatggttctctcgaacatcctctgattgttccttattcttctctaagaatgaggaggttagcccaggcatgtccttttcttgtaaagggcaaagggagaagagagaaagccctaatgcgcaattctattttagtctctgtattgggaacaactgcaaaatcccactgtcagtcaaagcatgtcatgtggttgaggccactatcaagtgggagggcagatcagcccggtccatagaatttgcatcaataaagttcataattaaattccagaagtcatattagtaaatgtgaagaatagtgtggcctcaaaaataaaactatacagatatttattaatttgtcagttattttattttataaagtgcttaatctctgtcagtgggccagcctgcagacaaccttgaggagaacagagacagtggttgtttcttagattgcagaatgcatttacttagatgtacatctctgaggatactcatttgtttttctctttagaatgtttactatccattgaactggcaactgtgtgttcatatgttaaaaagaaataaatagaagagtttattcctacagaaaattgataatacaaattattagtgtgattgaattttatcatgtttgcagaaaaaagcaacaataacaagttaaacaaaaacaaaaataacctttgccatgatttgaatgaatgtgttccttcaaaattcatacattagaacctaatacctcatgtgatagcattaggaggagagcctttcgggaggtgattaagtcatgtggctctgtcctcatgagtggaattagtgcccttataaaagaagttgaagtggtgccctagtcctttttgcccttcctccttctgccacgggagaaggcagcaacaaggcactattttcgaagcagagaatgacctttcaccagacaccaaatctgccagcaccttgatcttggacttccagtctccagaactgtaagaaatacatttctattgtttctatgttattcagtcctggatattttgttatagcaggaggaacagcctaacatgctcttagaatccaagaaatctgtaccaacaaaacaaagttttttgctattttcatcacacagatggcatgtaaactttctgaaaataaaatctgtaggttaagaataacaaacagcataccatgaccagtagtatgtggaaatgtgctggtgctttctttaccacatgaatttggggcattcttttgaaaaattttacatggctatgattaaaataaatattgtaatacatcaacttaccagattgatatcattaaggtattataaaattaatctataatgtttgagttttagaaaaattttaatagaaaaagattaacttttctccttaatagatttcaaataaattctcaaagtgaagacctgtatactcctctgaattttttaatatagttgatgaaatatattttttttatgtgaagttaatttgaagggaataaatttagatgaaatacatttgagggagaagttctgagcttgattagacaatttagttcaatctttaatttaggcaactggcccaatgataatgcattcctgttctattatgtccagttcaaacatgcatgatctctaagactccataataacgacatttcaaaagtgtgttcaacattgagcttgctgtccattttagtctcacacctttgtattcccatctcaactatctaaataaatccagatttaattctatcctcttgccttatccttacccttgccatttagccttttaataactttctctaaacaaatctaaaaggtgttccctcttttccattttcaatattactaacttagctaacctcttctcatttgtattaccacaatatcttccaaataggacttgtcaatttatttattgaagacattcttattatgcatcaattatgctacatgactattgctacatactaggagtataacaacagatgcagtccctcccctcaagaagtctacagtctaatgaaaaggacagatctagaattgggtaggtactttcatgcagtatggagaaaagtctaagcattatgagggcctagttacagactcaagagggataatgccaaatagaaataggatttggtgggacagtttgatcaattgcttaaacagaagattcatcaagacaatttgcaaaggataaaaggtatgtttacggttattgctggacactcatgagtcaaatatcaaataccaggtgatttgtgatgtgagaagagtataaatagatactgccttcaaagcattattgttgtaatttttaacatgttctatagaataagttataagctacataaatcgttctttcaaatgttgttgtttttgttttttacctatgtggtaaaaagctacttttattgcacataaaatagttaacatagggtttagtttacctttatatgtgaaagttgcttcagtttctttaaacagaaatttttctctaggtcatgaataattggacctgaaaacagtgagctggtaaggaaatgaataaagaatgtgctgggggatttttaaccttttttgttcaacatgtaagcctttcattagcattaatacaacttcaccttccatttgtacattattaatgcattacagttttgaatggtctgcatccaaggaacacttgatgtcatttgaaagtgaatttattcattaacctgtgtcccttagttgcagccagctttgtatccctgttttctgatggagctagcagccagctttgtacctgtattgtaagtgtcaaaaataaaaagttagggcaagctttgtttcctcttcccttcccactgacattctctaggttactggcattttcaagctttgagccaattttacaatgggccttactcaaatgaatagcttatgggaaacttttcacatatggtggagacaaattcttaaaatagcagcattattataagaagaagtgatgactcagagcatgctatgaataaattgctttcctgggtttagtgtcttattctaaatgggactctaagtctttcctctattttaagaaagaagtcaggcattagcaataagagtttatttataatcatgttcaataaatgagtctgatgtttggttagggaaatcactaaaaaggtaggtcagaataaaagaagaaatatatgtggaaaatgacagacttagttgtgatttctacttcttagctatgaaatgtggtgaacgtgtatggtgcttcctttattgtatactgggaaattgcaataactctagctattgcatagctcttgcagggatcagagataacataggaaagggcccagcacagtgaatgcccattttaataaataacaaagatgttgcttcactgaaagaacagcagactctcagaatgcatcacacacactaaatgaagtattttcaaattacttataatctgtgcttgtgttcagccatcaaatgattcagtgtcaggaacaaatgatggattacatattatatgcctcattctcttaatatgaaaaattctgcttgataaaatttcaacatttcatcttcaattgcacatggattaatcattacttatgatcacattgtatgtatgtatatatatacatatatatgtatacatatgtgtatatatatatacgtatatgtgtgtgtgtacatatatatattgaggtgcagtcttgctctgtcacccaggctggagtgcagtggtgcgatctcagctcactgcaacatccacctcccaggttcaagcaattctcctgcctcagcctcccgagtagctgggactacaggtgtgtgccaccactcccagctaatttttgtatttttaatagagacggggtttttaccatgttggccaggctgattctgaactcctgacctcaactgatcctcccacctcagcctcccagtgtgctgggattacaggcgtgaaccaccacacctggcccacattgtataattcaatgtgattgcattgaatccaaggttctgtaatgcttacctgtttgcatgcattccttcaaataagatttatctcttatagatagtagctcataggcaaattattcttctgcagaacgtatttttcttttatattctttaattaattatttaatcagcccttagattgaaacagttttaccacatacatggcttttgccattgacagtcttcaatgattctgttatagtgaactccagtagtaaaagtgctgggatttgttgtgttgttctttcttcatctttactttcaggttttgcgtatgggaaatatttaattgtattttaaaattcaagaaaaattatatgcttatcatttcatataaatgtccaaggaatatttttaatgaaacactgtttttgactgtcaaaaacaaacaagttttaataaatcaataggtatcttaaatccattaacactatatgtaaatgtattacatattctattctatagtgcatattttatcacttctcaacttgcatttcatgggaaaaagaaagtgcttgcataaacaatgttaaatgattttcttttatgaaaatatcctcagactatcgtgctaatgaagctcaccaaacgtacgtgaccacatttgacttccttgttctggaggagcaagcaggagcttcacaggtccatggaaagacatgggaaagtaaaaatctggtctgtaattacttaatataaaggttttgggtcaaattccaggctttaaaatattcaaaaatttcatcatacattgctattagttttgttcatttatttatttcttttgctctctcctttcgacttgatctctaccaagttcagcaaattaagactattactaatggcaggaattattcaatccaaattcaaggtcctttgaccaaagttctcgagagaagacagagaccattgggcttgcacagtccagaaaatattactggctgttttcaccatgccttctctaaagttgggcatttcataggcttttataagctctcgttttagtatatgtttcccccacttcccgattacaggcctccaataacatgacaaccacataactacagggaaatgaagtgatttttcttcattaaaattgattctgttttaatatgtttattttacaaaagttggaattattgcacgtcccctgcatgccagtaactccattaggacccagggcttcaacagtgggtcagttagactgactggaagctctcattacaaggagaggtgcacagcaggagggattcatggcaatgaggcctatggaaaaaaaaaaggagaaaggtattgacagagaggggtttcagaaggtcttttagtagttttgcaggaaaagactccctaaggcagtaatatttgtagtgagaccatagcaagaatggaatagctatgaaatgagtaggagtaaaaaggtttcaaagagaggaaatgagaagtgttaaatcagaggcatgaaagggctttgctatttgcttttttccaagaacataaggagggcagggtgaggaagagggagcgagagaataaaaaagataattctgattgtagtgtagaaaataaattcatgtttactttatcaaaagcttttattccatggtgttatttgtatttaacatttgctttgtattttaaacaatcttagttacattttttatatttgatatcagaaacaggaagggtcactggctgtggaagatatcacagatataatatagataatcacaaacaaagcaacagaggtgccaaatgattttaagtaaggaatctctgtttgggaaaggggtgggtgtcggagacatatttaaatgttttcctcttatctgagttccgtatagttttagttgaatatgtggtctcctcgggctaataataagtaatgtggccatgcaatttgctgcccaagatgtgataataaataattattagctaacaaattggtttcctggtattggttcacctgtaagattattttgtcaagcattatttttaaaagactgttatctctaaaatataaacatatactaggcacactaaagagaaactgagagatatttcattctattaattatctaatcattaataagtagactaatcatttttggtagattatttttggtagaggatcacagtttgttgagatgcaattatgaatggcatgttcaccaaaatcaattcaggtgcacttcaggtacatatgttttttaatttagaagaatttgatcttgctacaactctgtgctctattaattgcatatattcatattatcagtgtatagtaaataacataaccaatgttaaaggtttagatgaatttatggtagcattcaaaataatagagatagtttaatttgatagaaataaatttctaaaacttttattctacaaatgggatggaaaaaacagttattagagttaacagatttttttaaatttgaagcattaatagaaagaagacatcatttaattatctgtggatttattctactaatggagacaaataaatatcattcggctcactttgataagaaaacttcatattcaaaatgagtatatttcatttatatggagaatcgttggatcaaaataaaaagttatgcataaagaatgatttgtaaatataccttctccatctaaatatattagatcaacttatttgggcgacgttttgtttttaaaataactactaatcctgtatttcaagcatatgctaatttgttccatttggcttttatgcaatcagttattcccatggtgaatgggtgaacattaaacaacattttgtgcaattgcatacttcttatcaactttatgatatattagaattcactagtcaatttttcatttaatgctcaccttacttttttaacttaactaaagttgagtctaaaacatcaaactgtaagataagtatatatagttctatattataatccaaaataatataaaagtaataaatatagtcttaataatataataaacaacaaaacgtcttttacaagcattcaggttactgcttacaaactctacagaatggccatttatcctctttcctgtccatattttaagtacgtgacacctctaatttcctctgtttttcaccgccccgttgaaagattgcctgatgccagaggacaggttgcagcaagcaggctgttacaccaactggctcatgagcagaggtgttgaatacttcccctgcaatagacctgaagaaacaagctgcctttagcacctcatatccagatgcacttagttttatcagcaagtaccatgtctattgcatttttgctaaccaggagaatattctggtttgatataaattttgaccaccaaaaacaaagccttgtgccgatgctgctgaattacagaggtgcatcttctctacccacgcttcctgagtgtgactgtaggattggcaaggctctttagtattccacacttgaaaaagaaatgaacttctacctactctgtcttccctctcaggttataacacaataatacacatcttcacattttatccttcttcagtgcctagttgtgtacaggtatgtgacatgtggtatgtgtgtgtacaaatataatttccatttggagagctaacttcctaaacccacattaacatgttattaaccaggaactcctcattgcattaaaatagtgcactgaaagagctcataacaaagtcattcataatcttctcatcaatatcactaatttctaaaaattaataaataaaatattttattactgtttattacacaaggtgctatggagcagttagtaaggacacatatttcagccagtagtgtgtttttgaaaaagcttccctaaggagttatgattttcctggagactgaaacataaaacgagacatgaactggccgaagttgggggagcgctcaagtggggcccctcaggcagagtgggcaacaggcaaggtggaaggaatgagcaaaagcatcatgatttgtgaataatcaagagttgcttggctggaacagagtacagttgaaagtcagtggcaaaaatgagattagaaatttgaggctgggcgcactggctcacgcctgtaatcccagctctttgggaggccgaggcaggtggatcacaaggtcaggagatcgagaccagcctggctaacacagtgaaaccccgtctctactaaaaatacaaaaaattagcagggtgtggtggcggacgcctgtagtcccagctactgaggaggctgaagcgggagaaaggcgtgaaaccaggaggtggagcttgcagtgagctaagattgcaacactgcactacagcccaggcgacagagtgagactctgtctcaaaaaacaataaaataaagtaaaataaaataaataaataaataaaattgagcaaggctaaatcttgaaggattttgtgtgtcttaacaaggatttaaatctgatcatgatactaccattgaaagatgttatgtagcagaaatatgatttaagttgaaaaaagggaagggagtgggcttacattatacaatgtggaatgtcaagagtagagaaaataaattaattttgaatttactgtgaatacgcaagagagaaaaggtatctaaactatattagtggtgtataatgataatgatgacatagagattcatgaggtgtgtgggaattagaattaacagaattagaggcagggagtctgatggtaaagttgattttattttcaaatgtaatgcttagaagatggagtaaaagtgctgacaatccctaaaataaattaaagaagagagtggttgaggggaagatgaaaattcacttcaaatatatcaattttaatctctatacaagctgtcttagattgggttccgttaagagttttctttgagagagctttcaacagatgatatttctagatgctgggagtccagcagccctcccaacagatgtgagcagagaaccacaatatccactgcagtgcacatctcccattccacagccccactggctttttatgctaaagtgggcccatccaggtgcattttggattctcactggccctggattctcactggtccttctgtagaaaacaagagaagggttagtgagatgataaatagcccctgctgctatggctgttgtcaaggccataactgacaagcatcatcccctcctccactcctcattcttgattggccctgtcattaccataacatctgctgctctgggaagtttgcctcctgggctaactcacactgtcatcccaagagctgatcctgtggctatggatgctgatttattcccactgaccattaaaagtgacaatggcagcataaacatttagcagagttattgcatgccaaataagttcttcttcaccttcctcctacctcctgattgtgttaagggacaattatccctgcagaaggtgactccttaaactgtttactgatctcttggtacaaagtgtttagaagcaccagaaagcaccgtggcttatggcctccacttgcacagtacagagttgtcagcacaagatgctcacattccccatttgagcagctgggaaaggtgatagctgcaacctgtcctaaatccacctcttcgttctctgacccatgtagtctacctacctgccagggacacagaactgtgtattggtcagtgattccaggtctattccaccacaccttgggggtggtgtccccttctcatagtatatctcctagatgaaacactaactatatacgaagaggccattgaactgtctgtcctcttttgcccaaactctgagggtgatgcagcgccgagggcaccactaggtgtcttgatgatgctccagcacctcttttgttgtacaatggttctgtagggatgaggagttacaaagactcctgcaaaaattctgcaagtcctaaaatgttgaggcctggtgaacaggaaaggcaaactcataccagagtgtgtgtctattcatgtctaaataaattaatgcctctttggggtgaaaagagcccaatattatcaatctgccaccaaatagttgattgatttagccacattggtggcaccttgagcactcatttttggcttctattggtgacagattgaacattcagctgtggtagaagctggatcctcctgtgtgcatgaggagtcaggttgggctcatgtgtggcccgcatttgttaatgcattctttatgccaatgacagagccaggctgttgtaaaatctctgaagtattaggagtgctcattgtttggggctttttcctcggacccctttttccctaatgtgatattttagtaatcctagatccctgactgggtcaaatctttcacctctgtccatgaatcacccatattcttatctcattccacttgtatttgcagaaaatggatacccagatgcactgtccagagttctgtgcagtggggagcattttctcctcacttatgttttaagaacaactaactgaggggctgttgaagaggaaacctcaatatttagcttgcatgctgagcctgtctatctgtgagcaaatcttcgccttttgttctatcttaggtcaccatagggattgtcccttaggtggcatatttgctagttgttgagtggtgcaggtcctaggctggtgatgagatggacacctgggctgccagcttggatagcttgctggtgccctgtggcttggctcatccctgattccaggtgaatacattacatactacaactttttacattgccctgctgtaccttatagcttattaggcagacagagtccaaatataatgtgtagccctggatacatgggatacatgtaagcatttctctctacaagggcctctgactaagaaatggtaagcagatttgctggagatggaatcacttttctccagagaccaaagaggtctatattgtgattctcctatgagggcttcacataaatttcacacaggttctttctttggaatagacacttctaatgtcatagagtttggcaaattaagttaagcccatgtctacctcccctccagtgatgggggtctcttttgtcagccagctagcaggcaatccatgtccaatatttcatttttgcctttgtattgagaactacacctagcatgagctatgctagtttgaatttcatagagtagtattcacggcagagaaataggtttgtgagttggtacactcaggacacacctgtatgtaaagaggaagggaggataggcaagaaggataagctgacccacaggtaattgtacctaagggctagtcatacttaaggggaattctgaagctttgattgtcctacagagttatcctaacagaaacaacagggtcagacatttatatttctatatcacctaggacttcaactgtgaccaaggaattcattatgatgggtaaaaaggcaaatcggcagcagcaggtaccccgagcagctgggagatgggagtgctaaccctgacctggagggagcaccccgtattcactacacggactgcgatgctaaaaagtagttggataagaaaaaatgagagcgattgggaagagaagatagatcagtttcagaggagactggaagaaaaaaatttcaatccagaatattgtacaaatatactttggaaatgataaggtttaattaattttgaatgaaagaaagtgatttgaatatatgaaagtaaaactatatttggaaaaacaaagagaaccgtggaaagacatgcttagttttctctgctaagtggagggggctatgccacatattgagtgaggccgaggggatgaaggcattaattagtgtgaaaaagaacactgctatttaaaaggctttgaaataatcaaattagtgaaagcacatatctcttcaaaggatttaagcattcacagtaaaaaattatttctgcttttattatttcacactattttggcactactcagcactctgtttgctctgacattaggggcattacatgacaaaagctttatgcattaacgaagatgaacaaaaagattataggagcaaatggaacaagaggatgtgttttgcagacgtgatataacctagaactagcagtcagcatatgtaccattaatggcattgaaaaatcattatagacattcataaggatatgttgtctcaaaatgctatgaattttatgacatgtttaagatgaaataaaaagaatttttaatgaatacagaaagatccatcataaaatatgaaggaggcaatattcatcttcagaaagttcttacttctgcttccatatcctcccagaagcatcaccattagtacttgtattcaggtgacttctgacattcaagtttgccatcagcttactgttctattggaagaacgctactaaactagtttgaaataatagaggaaaaaactttgcaatctacaaagcgattttatgagcattattatttcacccctttttacactcacctttaaagtagaatagtcagacattattacttctaatttacagtaaaatatgatcaggctctaataaattaagaatcttgcccaaagtcatgtggcttataagtagaatataaaattcagattacattttagggtttgtggctctgagctcagtattcatctttatttcagtacactgccaacaacaaaatacatgatcattcctgggatatatgcattgtaataggggaaagcatcttaatttcctgatgatggagttcaggccagtgcctggagaagagggcacaaaaggagataaacaggagagagtggtttctggtctttagaatccccttgatctcattcgatgtaggcaactactgattatcctagagtgcatgaactttaccagtatgagaaaaagggagacaaattggcatatttttttgagagttttagtatcattatgcaaattagtaaattctacacatattttatacagatctcattactatatcttgatttactttctacctgattgaaaagcttttgacgccaaaaattcttgctcctgtgtttcttactagcacctggtttctaaccaaatcaaagtgaattaaataagccatcccactctacacgtacttctaacagcttactcaacactctcctgtctgggtctacctcagagccagctataaggcatttacaatggcactcacaatttgcattacagagcaatgtaaactacatgctatcaaaaatggtgatgtctgctcatccttttcatcattaatattcttaacacaattgccatagtgtttatcagaatcttaggaacaaaatattggtaaaagaaataagactgccaataagtccttgagtttagccatttttcagaactttataactttcattgacaataattttgacttaggttattccaaattggccttagtaaatttctttgagttttacaagtttacacaatttgcctacgttcttgtctcttttcctagtttactgcattatcttttagctgacaagtccttcagttaagtatattcattaacttctttatatccatctttggggtatcctactgatagccaaggattcatgcttcatattcaaaaatgtatcaaacctctttcatatgactctaatacacattcttatagccagaggaactttattatgagtttttaaagtctgttcactcttaaaagtacatctagttgaaatagcaaatacctgtttaatagtgtaattactatatataaaatatcatttcaaatttataattataatttgagaatttcaaaaccttgcatttatagttaagccaagctaaaaataaagtatcttgtccaacactacacagtaggttaatgtcaaggcgtgctacaaacagtgaggtactttggcagacattttttctctatttgttacaggtgtctttgtttgttttaacataaaataaatttcacgtccttatgtttcccctaacattatattacttgcatttttccgtatatctacataatactcatcagcattattttaacacaaaatgtttagaattttcattttttgatattcattaataataaggtgtttaacatattcctttacattttatatattgtatttccatacaattaatttttataaatggaatttctggatcaaataatattaacattttaagggcttaaaatatatatttaaaattgctgtactaaaattttacaacgtcatcaacaatgttatgtaaatattttttccacataaccttactagctttagttaatataattttcagtgatctttactaatataatgatgaaaaaaacagtctctgtaatattaatgcagtcttcttgatttctaatgaggttgaacaggttctcctatggttgttaacaaaaataattgtttttccttttttaaaaaataacatctttctgcaatattttttgtattttgtgtatttttttcaacttttattttagatacaggaggcaaatgtgcaggtttgttacatgggaattttcatgatgctgagattcaaggtatggatcctgccactcagactgtgagcatagtacctgatagacagtttttcaacagacaaccccctccctacccctctagtgttcttcagtgtttattgttctcatatttatgttattttatgctcaatgtttagctctccttacaaatgagaacatgtggaatttggttttctgttttgcatttaatttgcttaggattatggcctccatctctatccatgctgttgcaaagggaaagattttattcttttttatgaccatgtagtattccatgatgtataggtaccacatttttttttccaatctaccattgatagggacttgggttgattccatgtctttgcaattgtgaatagtgcagcaatgaacacatgaatgaatgtatctttttgatagaatgatttatagtcctttggatatatacccagtaatgggatatctgggctaaatggtatctctgttttaacttctttgattaatcatgagactgctttccacagtggtggtgcaaatttacattcccaccaacagtgtataacactctcttttctcttcagccttaccaggatctgttgtttttgacattttaataatagccattttgacaagtgtgaaatggtatctcattgtggttttgatttgcatttctctgatgattagtgatgctgagcattttttcatgtgtttgttggctgcttgtatgtcttcttttaagaaatgtgtgttcgtgtccttcgtctattttttaatggagttttttcttttctttatcaggtgcttagagtttttcttacattttatcgtattttatactatatagcattatgactattatttttcttttaatattggttaatatgcattaattttactaaatgaatttgtaatttcttattactgtcatgtctaggacttcatatatttccaaaattactaaaaattcacttatataattctatgtaatttttctataacttagattgcttaaattactttactttttgaaatatgagagatttgctttaaaggaagttatgtgatgaaaaacttaactttaaaatattttttccaaagacttaattgccccaaatagttttattgtgaaagggatactatataaaatatatataaaggaaacattgaagatgaattgaaatgactggatattgcttttcaataacttgcataggttaatgtagtaagaaacaaactatagacatttatttatacagagactattgcttctcggccttttggctaagatcaagtgtagtatttatatagagactgacatcttcaggatagtgacagtatctttttcattctaattatctagcaaaatactcagtatatactagccacttcataaatatctgttgaataaataaattttttaaatgaaattctatattaatttattctgcctcaatatcattacatattacttgaaaattctcccatcattattgacatatctatgattttaatgtttcactatgtatttttaaaatataaaaattttaattagtatttgctttgaatggattttgaactatgttgtttccagaatcttttctttctaaatggtggcactttctctctctctttcgctctctcatctctttctctgtctctctctctctggagatatatatagatatgtatatatggacatatatatatctctctatatatggacattatatatctatatatatggacatgtatatagatatctatatatatggacatatatatagatatctatatatatggacatatatatagatatctatatatatggacatatatatatctatatatatggacatatatatatctatatatatggacatatatatatctatatatatggacatatatatatctatatatatgtccatatacatatatagatatatatggacatatatatctatatatccatatatatctatccatatatatgtccatatatatatatctcaaccatgcaacttgtaatgttaaacaattttacaattcagtggctttaattaatttacaccactgtataatcattactactatctgttcatcatccgaaacagaaactctgtaactattaagcaataattactcattcttcctgcccgacatattggatttaaaaaatgatctaactgtatgctgtacacaagaggctaacattggatctaaagacacaggtggtttaaaagagaattgttgagaaaatatattccatgcaaatgatagccaaagaaaagctaattttctaaactaatattagacaaaaactcctccaatctaaaggagcatgttctaaaccaatgaaaggaagctaagaaacttgaaaacaggttagaggaattgcaaactagaatagccagtttagggaagaacacaaatgacctgatggagctgagaaacatagcacaagaacttcgtgaagcatacacaagtatcaatagtcaaatcgatcaatcagaagaaagggtatcagagattgaagatcaacttaatgaaataaagtgtgaagacaagattagagaaaaaagaatgaaaaggaatgatcgaagcctccaagaaatatggaactgtgtgaaaagaccaaacctatgattgattggtgtaccagaaagtgatggagagaatggaatcaagttggaaacactctttaggataatatccaggagaacttccccaacctagcaagataggccaacattcaaattcaggaaatacagagaacaccacaaagatactcctcaagaagagcaccacaagacacataatcatcagattaaccaaggttgaaatgaaggaaaaaatgttaagggcagccagagagaaaggtcgggttacccacaaagggaaacccatcagactaacagtggatctctctgcagaaaccctacaagctagaagagattgggggccaatatttaacattcttaaagaaaaggattttcaacccagaatttcatatccagccaaactaagcttcatacccaaaggagaaataaaatcttttacaaacaagcaaatgctgagagattttgtcaccaccaggcctgccttaccagagctcctgaaggaagtactaaatatggaaaggaaaaaacagtaccagccactgcaagaacataccaaattgtaaaggccatcgagactatgaagaaactgcatcaactaatgggcaaaataaccagctagcatcataatgacaggctcaaattcacacctaacaatataaaccttaattgcaaatgggctaaatgccccaattaaaagatcaaaaaacacaaagaagggcattacataacggtaaagggatcaatgcaacaagaagagctaactatcctaaatatatgcacccaatacaggagcactcagattcataaagcaagttcttagagatgtacaaagaaacttagactcccacacagtaagagtggaatattttcacaccccactgtcaatataagaccgatcaacaagagagaaaattaacaaggatattcagaacttggatcagctctggaccaagtggacctaatagacatcaacagaactctccaccccaaatcaacagaagatacattcttttcagcaccacatcgcacttattctaaaattgaccacaagattggaagaaaaaacactccccagcaaatgcaaaagaatggaaatcataacagtctctcagaccacagtgcaatcaaattcgaactcaggactaagaaactcagtcaaaactgtacaactacatggaaactgaacaacctgctcctgaatgactactgggtaaataaatgaaataaataagttatttgaatccactgagaataaagacacaacgtaccggaatctctgggaggcagctaaagcagtgtttagagggaaatttatagcactaaattcccactggagaaagtgggaaagatctaaaatcaataccctatcagcacaattaaaagaactagagaagtaaaagcaaacaaattcaaaagctagcagaacacaagaaaaaactcaaatcagagcagaaatgaaggaaatagagacatgaaaaacccttcaaaaaatcaatgaatccaggagctggttttttgaaaagagtaacaaaatagaccactagccggactaataaagaagaaaagagaaaagagtgaaatagaaacaataaaaaacaataaagggcatattaccactgatcccacagaaatacaaactaccaccagagaatactataaacagctctattcaaataaaccagaaaatgtagaataaatggataaattcctggacacatacaccctcctaagactaaaccaggaagaagtcaaatccctgaatagaccaataacaagttctgaaattgaggtagtaattaataacctaccaaccaaaaaaagcacaggactagatggattcacagcagaattcaaccagagttacaaagaggatctggtaccactccttctgaaagtattccaaaaaatagcaagagagggactcctccctaactcattttatgaggccagcatcatcctgatagcaaaacctagtagagacacaacaaaaaaagaaaatttcaggccaatatttctgatgaatatcagtgagaaaatcctcaataaaatatgggcaaacgaaatccagcagcacatcaaaaagcttgtccaccatgatcacgtcggcttcatccctgggacataaggctgtttcaacgtatgcaaatcaataaacgtaatccatcatataaacagaaccaattacaaaaatcacatgattatctcagtagatgcagaaaaggccttcaataaaattcaacacccttcatgctaaaacccctcaataaaataagtattgatggaaagtatctcaaaataataagagctatttatgacaaacccacagccaatatcatactgaatgggcaaaagtgggaagcattccctttgaaaaccagcacaagactaggatgccatctctcaccactccaattcaagatagtattggaagttctggccagggcaatcaggcaagagaaagaaagaaaggatattcacataagaaaagaggaagtcaaattgtctctctttgcagatgacatgattatatgtttagaaaaccccatcgtctcagaccaatatctccttaagctgagaagcaacttcagcaaagcctcaagatacaaaatcaatgtacaaatatcacaagctttcctatacaccaataacagacaaacagagagccaaatcatgagtgaaattttattcacaattgctacaaacagaataaaatacctagggatacaacttactaagaatgtgaaggacctcttcaaagagaactagaaaccactgcttgaagaagtaagagaggacacaaacaaatggaaaaacatccatgctcatgaataggaagaatcaatattgtgaaaatggccatactgcccaaagtaatttatagattcaatgctatcctcatccagctaccattgactttcttcacagaattagaaaaaactacttcaaatttcatatgaaactgaaaaagagcccacacagccaggacaatcctaaacaaaaagaacaaagctggaggcatcatgatacctgacttcaaactatactacaaagctacagtaaccaaaacagcatggtacttgtaccaaaacagagatatagaccaatggaacagaatagaggcctcagaaataacaccacacatctatgaccatctgatcttccacaaacctgacaaaaaaaaaaaagcaatggggaaaggattccctatttaataaatggtgctaggaaaactggctagccatacgcagaaaactgaaactggaccccctttttacaccttatacaaaaattaactcaagatggattaaagacttaaacataagacgtaaaaccataaaaaccctagaagaaaacctaggcaataccattcaggacataggcatgagcaaagacttcatgactaagacacaaaaagcaatggcaacaaaagccaaaattgacaaatgggatcttgttaaactaaagagcttctgcacagcgaaagagactatcatcaggatgaacaggccatctacacaatgggagaaaagttttacaatctatcaatctcaaaaagggctaatatccagaatctacaaggaacttaaacaaatttacaagaaaaaaacaaacaaccccatcaaaaagtgggccaagtatatgaacagacactctcaaaaaaagacatttatatagccaacaagcatatgaaaaaaagctcatcatcactggtctttagaaaaatgcagatcaaaaccacaatgagacaccatctcacaccaattagaatggtgatcattaaaaagtctggaaataatagatgctgaagaggatgtggagaaataggaacacttttacactgttggtgggagtgtaaattagttcagccattgtggaagacactatggcaattcctcaaagatctagaaccagaaataccatttgacccagcaatccattactgggtatatactggatgtggggctgggggagggatagcattacgagaaaacaacatagataatggattgttgggtgcagcaaaccaccatggcatgtgtatcccagaacttaaagtataataaaaaaataaaataaatacaacgtggcggcatcactccatttgattttaaacagggctatagtaaccaaaacagcatggcactagttcaaaaccagacacatataccagtggaacagaatggggaacccagaaataagaccatacacctacaactatttcatctttgacaaacctgacaaaaacaatcagtggggtaaggattccctattcaattaatgatgctgagataactggctggccagttgcagaagaaattggacccctttttttgcaccatataccaaaattaacacaagatatattaaagacttaaatataaaacccaaactataaaaactctggaatacagcctaggcaataccattctagacataggactgggcaaagatttcatgatgaagatgccaaaagcaattacaacaaaagcaaagattggaaaatgggatctaattaaactaaaaagctctgcgcagcaaaagaaactatcaacagagtgaacagacaaccaacagaatgggagaaaatttttgcaaactgtgcatctgacaaaggtctaatatccagcatctacaaggaacttaaacaaatttacaagaaaaaaaaaacagccttattaaaaagtgggcaaaggatatgaaccacacttttcaaaagaagacatacatgtggccaaaaaacatatgaaaaaaaaaaaaacctcaacatcactgattattagagaaatgcaaatcaaaaccacagtgagataccatctcacacctgccagaatggctaccattagaaacaaaacaaaacaaaacaaaacaaaaacaatgctgacaaggttgtagagaaaaaggaaagcttttacctggttggtgggagtataaattagtttaaccattgtggaagacagtatggtaattcctcaaagacctaaaaatagaaatattatttaacccatcaatcccattactgagtatatactcaaaggaatatagattgttctatcataaagagagatgcacaagtatgttcactgcagcactgttcacaataacaaagacatggagtcaatctaaatgcccatcagtggtaaactagataaagaaatagtggtgtatatacaccatggaatactaagcagccataaaaaagaatgagatcatttacattgcaggcacatggatggagctggaggccattatctttagcaaaccaatacaagaacagaaaaccaaacaccacatgttctcacttataaaaaggagctaaatgatgagaacacatggtcacatagagaagaacaacatacactgaggcctatcagaggacggaggtttggagaagggagaagagcaggaaaaataactactgggtactaggcttaatacctgggtgacaaaataatctgtacaaaactcctccatgatgtaagtttacccacataacaaaccttcacaagaacttttcttttttttctgaggcagagtcttgctctgtcacctaagctggagtacagtggtgcaatctcagttcatcgcaacactcacctcctgggttcaagcaattcttcttcctcagcctcctgaggctggcattacaggtgtgtgccaccagtcctggctagtttttgtatttttagtagagatggggtttcgccatgttggccaggctggtcttaaattcctgacctcaggtgatcttcccgcatccacttcccaagtgttgggattacaggcacgagccactgcacctgaccaagtacccctgaacttaaaataaaagttaaatgtaagaaaaagataatttaacagtttctcacataacaaaacatactgttaccatccaaatcttattccatggtatttactcaaagtatctaaaaagctatgtcctcacaaaagtctgcacatggatatttagagcagttttattcataattgcccaaacatggaaacaaccagcattcactttagtatgtgaatggataactaaactatggtatacctggaaaatggaatattattgagcatcagaaaagaaaagccatgaaatggcatgatggaaacaaatgcacattactaagtgaaagaagtcaattggaaaggattatatactgtatgattccaactatatgagattctggaaaaggcaaaactgtgaagatggtaaaagaccagtggttaccagtgattgtgggaaagagagggatgagtaggtggaccacagaggatttccagggcaatgaaactactctgcaagacactgtaatggtagataaatgttattacacatttgttaaaatccatagtatttataacaccaaaagtgaacccaaatgtaaacttaggactttgaaggataataatatcaatgtaggttcgtagattataacaaatgcaccactctgtttcttttgcttattatttctgtgaacatgaaactgctctcaaaaataaaatctattattaattttaaaaaaatcatacacacacaaaattaaccaactggatctaacagacatatgcatgccatatattcaaccacagttgaatacacatttttctgaagggcacatgggacattcttcagattagaccatgtgttaagacacaaaatacgtcatgatagattttaaatgattgaaattatacaaaatatcttttctgctcacaatggaatgaaactaaaaatcaataacagaagaaacactggacaatccagaaagaaatggaaatcaacacactcctaactgtcaactggataaagaagaaaacaaatatttagaggaaaatgaaagtgaaacacaaacataccaaaatatatgagacaaagcgaaagcagtactaaaagggaaacttgtaggagtataagtatatatatattaaaaaagaggatgaaaacaaaaactcatctaaaaataagaaacatcacaaatcagtgacctgacattacatcttaaagaagtagaaaaagacgagtagactgaaagctagctagaaaggtgaaaacaataaagattatagttgaaaaaaataaaatagatactagaaagtaatgaagaaaaatcaacaaaattaaaggttggttccttgaaaaaataacaaaatttataagtctttagcctgattgtctcaacaagaagacccaaattactaaaatcagaaaaaaagagaagagacattttgataatattgtaaaaataaatggattaagagacaattttatgagcaattgcatttcagaaatttgataacctagatgaaatagataaattcctggaaatatacacactgccaaaagtgaatgaatctgtagctattaaggggattgaatccataatcataaatctgtcaacagagaagaggcctggaccacatagctttattggtgaattttaccaaacattaaaaaaatcaaagttattctcaaattcttaccaaaaaaaaaaaaaattgaaggagtgggaatgctttgtaagtcattctgtgaggccaacattaccttgacaccaaagccagaagaagatgctacaagaaaagaaaatagtagctcaatattcctaatgaatattaatttaaaaaactctcaaaaaatactagcaaacagaactcagcaacatattaaaaggattatacaccatggccaagtagtatttattaatgaaattcaaggaagattcaatatatgtaaatcaatcaatgtaatacaacaccttaatagaatgaagtttaaataaaaatacaagaatcttctcaattaatacagaaaaatacacttgtcagaacgcatcaacctttaacaaaaaaacttaataaactaggaatagaaagatatttgaaatatgaaaaacgacccacagataatattatatccaatgctgaaagactgaaagttttctcctaaatcaggaacaagaatacttgctttgacttcttctgtttgacatggtattattgacagttttagccagagctattaggcaagaaaaaaaaaaagccaaagaaaattgaaaattagtaaaattatctctgctcacagatgacataatcttgtatgtagacaactacacacacaaacacacacacatcagatgtattaggccattcttggatcagtataaagaaatacctgagactgggtaattcataaaggaaagaggtttagttggcttactgttcttcagcctatacaggaagcacggtgctggcatctgatggcttctggggaagtctcagggagtttttagtcatggtggaagatgaagtggaagcaagcttgtcacatggcaaaaataggagcagagagagagagagaggaggtgacacacatttttcagacaggatttcctatgaacccagactgagagctcacttattgccaaggggatggcccaagccattcgtgggtgcagatctttcagatatctgcccccgtgatccacacacctcctataaggcccctttccaaacactggggattagatttcaacatgagatttaagcggggacaaatatccaaactaaataaccacacaaaacctgttttggctaatacataataatagcaaagtcacagtatacaaaatcaacacacatacaaaaagagttgtgtatctatacactaacaatgaataatctggaaaagcatttgagaagacaattttatttacaataacataaagagaataaaataattggggatatacttaaccaagtaggtgaaagtcttgtatactaaaatctacagaaaattgatgaaagcaatataaaagaaacaacatcctgtgtttatgaattgaaagacatattattattaagatgacaatatgatacaacgcagtcctcatcaaaatgtcactgatattttttgaagaaatagaaaagtccgtcttataactaacataaaattttaaggatccccaaatacccaaaacaatcttgaaaaagaacaaaagttgtaggtctttgacttctgattacaaaacttattacaaagctatagtaattaaaatagtgttgtcctgtcatagagacagacataaaaacatggaatagaatagagatcacagaatgaacctcatatgtatggtaaaatgattttcaacaagggtgccaagaccatccaatgaggaaagagcagtgttttcaactaatggtgtttgttagtaaaacaaaatactcacctgcaaaaggataaagttagaccctggccttataccatactcaaaaattaactcaaaatgagtcaaagacctaactgtaagagttaaaatgataaaacttgtagaagaaagcataggggaaaagcttcattactttaaatttggcaataatttctttgctatgacgccgaaagctcaggcaacaaaataaaagatagataaattggacaacattaaagcgaatgacttttgtacatcaaagggtactacaacagagtgcaaaggtcacccacagaatggaagaatgtatttgcaaatcatatatgtgataatgggttaatatccaaaatgtataaaatgcttatacaactcagtaacaacaaaacaagcaactcaattcaaaatagaacatgagtagatattgcaacaaagaatatatacaaatggccagcaagcacacaaaaagatgaccaacatcactagccattagtgaaatgcaagtcagaaccacaggagttaccactttacattcattgggatggcaaaaatcagaaagaaaacaaacaaagttgttgatgaggatgtggagaacctcataaatggaagagtaaccctttctttcacattgctggtataattataaaatgatgtagcctctgaaaaacatttggtggttccacaaaaagttgaacataagttaccatatgatttaacagtgcagcttctcagtatatacaccaaagaattgaaagcagggacttaaacagatacttgtacaccaatgttcatagaagtatgactcacagttgacaaatggtgaatgcaactcaagtgtcggtcgataaatgaatggataaacaaaattgggattttcagacaatggaatattatttagccatggatgggcctcgaaaaccttacgttaagtgaaataagccacacacaaaaggagagatgttttatgattccccttaaatgaaatacctagaataggcaaattcttagagacaggaagtagaataaagggtgcctggggcagtggggaaagataagtgaagacatatgattaatgggtacagagttcctgtttaggatgaaaaaaatattctgtaaatggctagtggtaatgattacacaacattgtgaatgtatttaacattcttcaatcatacatgtaaaaatcattacgatgctaaattttatattatgtatattttaccacaccaaaagaaaatgtgaatgttctttttatttttataattgttaatgttaaataataatttgaaattagaaaataaggaattatagataatgtaaaaatacatgagtatattctacttaattttgactgttcttatacaaatgttttagtaataaagtaatcaagatatggagttttagtactctaaaagtcatgcttttcttcacatagatctatgttgaaataaactataaaactgtgttaagaccagctaccccagctgaacgaacacacacaacacatcacactcaaatcacatgccttaaatgaaagcctctcagggatatccactggcatcattaacaaaaaactgtgagtcctttttgattcaaagaaaatctttggcctatctattcatgagaaaaacatcgaaaacattacaataggtgctagtctacaaaatacctgacaggactcctcaaagttttcaagtacagtctgatgaggaactgagaacctgtcacagccaagtggagcctaagaagtcacaatgaataaatgtaacatgacaccataacagaaaaagacattaggttaaaactaaagatatctaaataaatgatagaccttacttaataatctgctgatattagtttattaactgtgacaagacaccatactaatgtgagatatcattaattgggcaaactgggtgtggagtggatatgaactttctgattgtcttaacatttttgtaagtcatatatatgtataatatatatttgcatatacatattgtaaatatatataatatataatatattatattgtaaatatatataatatatattatatatatacacatatgctttttattttccctgcaaaacatctttagacttgtaggatgggttcaatgtcattatgtagtcaaacaataaatgcaagtttacttttttttagtgcttttgctcttctgcagattgtatgctatctaaatatgctattgtgatattggatgatgaggtatagtcaaaaaaccttatagacttctggaaggaattctgatctagtaagaaatgaatttcattataaaactattagctccagattaacaccccctcaggtattcttggagctacaaatctggaaaagtagtataatgcactgtaggcctatataaattgaaaaattgtctcctgaaagggggtagcagaaaatattgacttcaatcatgaagggttatgcttcagtaattccttgttgcatctttctgaaatgatgcactgaactagtagaattgttcagaccatggacttaaactttttcttgagcgtgctactcatattcctccacatttgtcaaactaagggtgcctcagaaatctagcttaagtactacaagtttttttgtgcatgtgtgttttactcttaaaaaattggcgtataaaaattaatatttaagaacacatataaagtaaactgggtactaggattctaccttatcatatgcttaccttatgtattagttatacaattaaggtaacattctattattttatataatctccatgtcgaattttccttttacctctgttactttaattcttaaattttgatcttgttttagtattaatctgttgaagaaaaatgccaaaattttaatttcaaaaacaaaaattttcacacttcgttccttccttctttctttccttcctctctttttctctttctctctttctgacagggctcactctgtagtgcagtggcacgatcacggctcactgtagcgtcaaccactgggctcaggtgattctcccatctcaatctcccaggtagctaggcctacaggctcatgccatcaagtccagctaactttttgtcttttttgtagacagggtttcatcatgttgcccaagctgtgtaagacacaatttttttttaaatgtaaggtacattttttccccatgtaccaagataggaaaaaagcaaaaacacacactttattgagttgaaggtgaaagttgcagtttttttgtctggcattgttaccactcaccattaaaatacatatgtacaaatggagaccatgggtaatgtctcctaattataaacctgtaatatctaagctgaaaatattaccacgaggaaaagttatgcatatgaatatttactgtggaattgctggttggagataaacattttctcactccatttacccttaaatgtatttattggaacctttaccaatctcattttctcagtgtcagtgtgagataatcttggagaacaggcattttaccaggaattattttacattttgctaggtgaaggggtactactttctcattagaaactctgcttaaagaggctaagaccttaagaaatctgggttttaaggatcactggtgatatgttaaaattggtattcaggatatgtttaactataacttgctcttcatatgacagtgtgaatgtattgacataagtgctaatttacaggcatacctcattttatcatactttgctttattgtccttcacatatactgtgtcttttacaaattgcaggtttgtggcaaccctgcattgagccactctatcagctgtttttccaacagcgtgcgcttactttgtatctctgtgtcacattttggtaatgcttaaaatgtttcaaagctttttaaattacatttgttatggtggcctgcaattagtaatatttcatgttattattgtaattattttggagcaccatgaactgtgcccatataagatggtgaataattttaaccaaaaagatgtgtgttctgactgctccactgaccgtttcccacctctctccctgtacttaggcctccctattcccacagacacaataatttgaaaatcaagctaattaataatcctgcaatggactttctaagcattcaaatgaaagactcacatgcctctcactttaaatcaaaatctagaaatgattacgcttggtgagaaaggcgtgttgaaaacagagataggctaaaagctgggcctcctgtgacaaacagttaagcaagttgtgaatgcaaaggaagagtttttgaagaaatgtaatactgctactccagggaacacatacatgataagaaagtgaaacaggctttttgctgatatggagaaagtgttcatggtatggatagatcaaaccagccacaacattcccttaagccaaagcctaatccaggggaaggctctcttttcagatctatgaaagctgataaagatgaagaagctgaagaagaaaaggttgaagctagcataagtttgttcatgaggtttaaggagagaagccatctctacaccataaaagtacaacgtgaagcagcaagtgctgatggagaagctacagcaagttatccgaagatctagctaagatcattgataaaggtggctacactaaacaacagatttttagtgtagataaaacagccttatattggaagaagatgccatctgaaactttcataggtagagaggagaagtcaatgtctggcttcaaaacttcaaaggataggctgcctctcttgttgggaccaatgcagctcgtgactaaagtatagccaattctcatttaccattctaaacatcctaggacccttaagaattgtgctaaatctaccctacctgtactctaaatggaatattaaatcctgaggaacatctgtttacagcatggtttactgaatatgttaagtccactattgacacccactgcttcgaaaaaacaattcctttcaaaataatacggctcactaaaaatgtaccaaattatccaagaactctgagggagatgtgcaaggaggctaatgtcttcttgtctgctaacacaatatccattctgcagtccatgaatcaaggagtattttcgactttcaagtcttattatttaagaaatgcactttgtaaggctatagataacatagataaagtgattcctctgatggatcttggcagtcaattaaaaactttctagaaaggattcataattttagatgccattacattatatatgattcatgggaggaggtcaaaatatcaatataaatagggatttggaagaagttgaatcaattctaaaccctcttcggagacttggagaggttcaggacttcagtgaaggaagtaaatgcaaatgccatggaaataacaagaaaactaaaattataactggagccttgaagatgcaactgaattattgcaatctcatgataaaactttggtgagtgaggagtttcttcttatggaggagcaaagaaagtggtttcttcagatggaacctacttcttatgaaaatgctgtgaatattgttgaaatgataacaaaatatttagaatattacattaatttagttgataaacagcagcaggatttgagtgaattgactgcagttcagaaattctgtgggtaaaatgctattcggctatattgcaggctacagaaaaatctttcatgaaacagtcaatcaatgcagcagacttcattgctgtcttattttaagaaattgtcacagccaccccaaccaccagcaatcaccatcctgatgagccagcagctgtcagcatcaaggcagcaccctccaccagcaaaaggactacggctcactgaagacttgaatgacccctggcattttttagtaataaattatattttaattaaggtatatacatttttttaggcttaatgtcattgtacacttaatagactacagtatagaaacaaacatcacttttatatgcattggggaaccaaacaatttctgtgactcacttcattgcaatacttgctgtttcgtggtggtctggaacaaaatccacaaaagccctgaggtatgcctgtatataccccgaggtatgcccgtatatgcttttatctatcacattttattctgaaaaagatgtgagacatatactctgttctttctttactattttatcagcaacaatagcttaaataggactgcactcagaaaatatttgactatatcagctatgttttgttgatctatttagaaaccataagaaatcatttaaaaaatatttgaaacaataatttgttaaaagtattttctatcacatatttaatgagataaaggtatgctaagataaggtaaaacaaactacatggtgtgtgatcatgtttgaacacacatacacaattttcttctttaatgatttatatctttggtgttttactttggacatgcatgtttttagtttcaggacataccaaagagtgaactgctgcacctgctcccaggaaatatgatttatgatacaggatagacaaaaacttgttatagacaattcccacttattgccaatttcaccttttatatctccatttttgttatttggaaaggcaacagatttctgttactttctgcttcagagaattacatttgtagaatatgtttctgaaagaggctctactttccaagatattacagactgatgcagatgatggctctataaaatgcttattctgcatctcatgaaagcaccatgtcagtttttgtcataagggtttattcaagctaatatgtcatcttaataaagcgaaggttattagttgagcttcaagatgaagttccagaatgatcaattcaaaatcactttgtcacttctattgaaaaggactcaatgaaacatacagtgcttattgactgtgcacataagacaagatactaagagcaatttatttttatgcatttttgcaataattatttcatggataaaatatttctgaaaattaaatgataatattgaatcacaaatgttaacatttgataaatatttttaaatttcattttaaaatattgggacatagtactaactttgtatgattaacttttaccatttaaaaaagaactatttcttgatttgaaagcagatattaattccaccgacttacattgttttttttcccccctttaggctgtcctttggaggtataaattctctcagcttaaaggttcttcagatgatggcaagagcaaaatcaaatttttgtttcagaatccagatactaaacagattgaagcaaaggtaaacccaagaaattcatcacataacacctctaactacattaatgccattaaggaacaaagaggggaaactttcggggaatcacaagaccaaaaacacacattctctgctcatcttgaaatatccgtcatggccagaagaataaacttactttaagattttattggcaacttttcacttaaaggcagcacttaaaataaattacacaaaactaattgcatttcttagttttaattccttatgaactgcatttttgtcacactaaaataacatcctgggaactaaagcagtcctttggtagtttcattctaaataataatttaaaatactttgtaaaaatctgactatatttacataaatttatatatttacattttatttacatatattttttcacatattcaaaatctgcattattttcattactataatataaaattgacaataacaatatttgcattagaataaattataaatgcattatcccagtatagagaaaagggtaaataacaaagtgaaaaaattgtatctatggacatgaaagctcaatataatttttcaactatgaattaacattaccatatttctattatacccctttacttattaaattcagggctaagaagccttagcctgacattcagaaccttcccaggaatgtcccttgatgatatttttggcaaagtatcctgtaacactgctctatgtttagattagacactctccttcttttaacaaggtgactccttgtagcctgatgtatcttctgcttttctctcaactgttttccttagctttttgtctgagtatctctcgagatgtcccattcttgtctcttacttgtctttggactcatcttttctgcctcttcctagttcacaggttgtgtaatgtgggaactgtgtcgttcctacagcgggctcctttgccactgcatgtgtttccagggggttgcctcactttgtctcccatcagtttagacaaatgccttgctaacttcttccactccctttattttacatgcctcacaagtttttagcttacatttctaacacagcctcttccctaaatatagacccatctctgcaccggccctttctctacctctcgctactgctcctcttctcccacctcagctaccactgatcaatcatttactttgtgccaaccacttattttgataatatcaaagaatgcattactcttgtcaaattttttttacctttagctcttggtatatttcttaatctttcaaagcacagcacaaattttaatactggtgaaagatgttaatattgtcagttctgtattattctggcatttattctgatggggaacctcaaccaccagttgctgacagcggtacagtattcagttgcttaccccaacactttttaatgagctaacaaaccctttgcaaaggaacaagagtgataaatgcaatctaatggctactaactatggtatttagatattaatttagtgtagcgtgtattatacatgcaattaattatactgacaagtatactagaaattacctgtcagctactaagcattattcattcttgtaatttttgtgtttttaagctttctctcatatgtaattcattaagagatagtgtaagaatagatatttggttgagtgtaattctcgaattgataggaagtaattatggaatagaaaaaaaaagtagtcttaaaaataatgagactgtgacatttggtgagttgttgaaattctttaaagtcagcatctccctttataaaataaaagaaaataatacctccataggtaatactgaaaatacccaataaaatatgatgactatttaaacaacaataatgctagacaatcagaatgttggccagccctacagaattgtttaaccatacttgtgtgtatcacctgaacattacctctgctgacataaaaattgtgtaagaactggaagcaggacatttgctaactattgtataacctctataaccatgacttgtgagcagtaagctaacataccatcacaggagcaaaacaatcgtagtgtagatgttcttgtgtggacataagcttttatttatctgggataaatgcctagaagtgcaaattgcaccatagaatagaaaatgtttgtttagttttaaataaaatgccaaattatattctatagtggctacagaatatagataacattttatatcctaccaataatgtataaaagatccagtttctctacatccctgcaaggtttgggtattgtcacttaaaattttggttctgctcatcatagtcttcatttacatatccctcaagtctgataatgatgaacaacttgttatatgtatgttatatcctctttgttatatgccatgtatgttatatcctctttgttgagaagatttctcttcctgtttcttgcccatgttctgacaatattgttagattataattttttggtgccttgtctctgtttttctgttaattgtgctagaggtttttcaaagaactacattaatttttactgatttttatattgtggtctgtaatccattcaatgaattctgcccttttaatatttgcctattttttagttgctttggcttttattttgctctcatttttaatttttttgagataatattttagatttctgatttgaagtgtcctttctaatataggatttagttctataatttccttgttagcactgcatttgctgcatccccaaaattctgacatcttgtgtttctattttcatcggttcaatatgtttttatttcccttaagtctttctctttgacaaatggatttttttcctttccttttttaaatagactttagtttttcagagcagttttcagttcacagcaaagttgagtgtaaggtacaaaaatttcctgtataccacctgtccctacacaagcacagccccctctgtagtcaacatcccccaccagagggggggatgaagttatagctgatgaacttacagtgacacatcattaccatccagagtccatagttcacattacagttgactcttggtgttgcatatgttatgggttttgatatatatagtggcagttatctgccattatagtatcatagtcgtttcactaccctaaacatcttttgagctcttcctattcacccctatcttccccccaccccaagaaaccactcatttttaaaacttgtctccgtactttttcctttttcaaaatgtcatatagttggatcatacaatagttacccttttcatattggcttattttacttagtggtatgactttaagtttcttccatgtcttttcatgacttaataactcatttctttttagtactgaataatatccaattttctgaatgtacaacagtttatttatccattcacctacagacagacttctttgttacttccatgttttagaaattataaacaaaactgttctaaacatccatattcaggttttgagtggacataagttttcaacttctttgggtaatatcatggagtgtgattgctagatcatatggtaaaacagtgtttagtttttttaaaattgccaaactgtcttccaaagtaattgtagaactttccatctccatcaccaataaatgaaagttgcttttgctccacaatctcaccagtaactgttgttgtccatgttctggatttggaccattctaataggtgtgtagtggtatattattgttgttttaatttgtatttatctgatgatatacaacgtggtgcatattttcatatgctaattttcatctgtatatattctttggtaaggtatctgttaaggtttctggcccatttttaatattttcatacgctaattttcatctgtatatattctttggtaagatatctgttaaggtttctggcccatttttaatattttcatacgctaattttcatctgtatatattctttggtaaggtatctgttaatgtttctggcccattcttaattggaatttttgttttgatatcattgagttttaacagttctttgcatattttccttagcatcttttatctgctatgttgtctgcaaatatttttgtccaatctgcagtgtgtctttttgctctcttgagaatgtctttcatagagcagaaaattttaattttaatgaggtccagtttatcagtcgtttcttttgtgcatcatgcctttggcatagaatctaaaaagtcatcgcaaaagtgaaggtcatctagactttgtactatgttatcttctaggagtttttaaattattgtcttttataattggagctgtgttccatttggaattaatttttgtgaagggtgtaatatttctgtctaagttctttcttttttatttttctgcattgcctgtggatgtccattttttccaggatcatttgttgaacaggctatatttactccattgtatttttttgctccttagtcaaagattagttgactgtatttatgtcggcctatttctaggctttctcttctgttccattgatctatttgtctgtttctttcctaacatcatgctgtcttgatgactgtagctttagagtatgtcttgaagttttatagtgttaatccttcaactttgatcttgtttttcaatagtgtgatggctattctgtgtcttttgcctctctctatatattttagaatcaatttgtcaatatccaaaattacttgctggaattttgattggaattttattaaatctgtagttcaagtttggaagaactgacatccagacaatattgagtctccccgtccatgaatataaaatatattccatttatttagtacttctttgatttatcagagtttgatagttttcctcttatagaatttttatgtatttaattagctttatattaacttacctgacatgtgaccgagaatatctttcccttttttataattttagtagaaaatctttggatttcccaccgttaagtatggtatcagctcttggtttggtaggtaatttttatcaagttgaggatgtcccccatctattcctagtttactgagagtttttatcacgcatgagtgtcggatgagttttctggatctattgatacagacatgtgatttttcttctttagcctgttgatttgatgtaatacattaattgaatttcaaattttgaataagctttgtatatcaactatgatagtggattcttccatttcttcttgaagttctgtcagtttagccttacatatttgtatgctctattatcaggtgtatacatgctaaggattgttacgtcttttttggataatttatttaccgttgcttaatgtccctctttttccctaaacctttccttgttgaagtctgtgccacctggaatcaataaaaactattgctttcttcaggttagtgttagcatggcacatctttctccattcactgacttttaatccatatatgcctttaacattgaaagtggatttcttgcagataacatatcatttggtcttatttcttcatccattttgacaatctttattttttaataagcacatttaagaccactgatgttaaaaataatttttgatacagttggatgaatatccacaatatttcttatccttgtgaatttattgcccttgttctttattcttattttagtcttccatgttttacagcttttgtagttttaacacttaacataattctattctctctccttattagcacaacagttatatattgttttacttttattagtggtagcactaaaccttgtaaaatatgtttacaactaaaccaagtccgccttcaaaacaacactacactgattcacaggtggtgtatcttataataacaaaatcctcctaattcctgcctctccttccttctattattgttgtcactcattttgcttatacacaatcctatacaatctaatacattgttattattttgaataaactgttatatgttagataaataacatttcatttgtttctcttttttagaatttgcattttctgcatacattgcttatttgttcttgcatgtggtctattttatctattaaagcttgtggtatattaatcatagttgtttcaaatgcttgttctaataaatccagtgtccctgccatatctgcacctggtcatgcttgccctatctctgtaaactgtgatgtcttttttccgtgtattatgatttgcaatattttcttttttaattgtttttattataatttaagttcagagataaatgtgcagaatgtgcaggtttgttatataggtatacacgtgccatggtggtttgctgcatccatcaacctgtcatctaagttaggtattcctgctaatgctatcccttccctgccccaccccacctcttgacaagctccagtgtgtgttgtctccttccctgtgtccatgcgttctcattgttcagctcccacttacgagtgagaacatgtggtgtttggttttctgttcttgtgttactttgctgagaatgatggtttccagcttcatccatgtccctgcaaaggacatgaactcatccgtttttatggctgcatagtattccatgatgtatatgtgccacattttctttatccagtctatcattgatgggcatatgggttggttccaagtctttgctattgtgaacagtgcagcaataaacatatgtgggcatgtgtctttatagcagaatggtttataaccctttgggtatatactcaataatgggattgctgggtcaaatgtatttctggttctagagccttgaggaatcgccactctgtcttccaaaatgtttgaactaatttacactcccatcaacattgaaaagcgttctccacattctctccagcatgtgctatttcctgactttaatgatcaccattctaactgacgtgagatggtatctcattgtggttttgatttgcatttctctaatgaccagtgaagatgagcattttttcatgtctgttggctgcataaatgtctttttttgaaaattgtctgttcatatagtttgccaatttttgatggggttgtttgtttttttctcataaatttgtttaagttctttgtagattctggatattagtcccttgtcggatggatagattgcaaaaattttcccccattctgtaggtggcctgttcactctgatgatagtctcttttgctgtgcagaagctctttagtttaacgagatctcgtttgtcaattttggcttttgttgccattgctttttttgtcttagtcatgaagtctttactcctgcctatgtcctgaatggtattgcctaggttttcttctaggggttttatggttttaggtctttgtttaaatctttaatccatcttgagttaatttttgtataaagtgtaaagaaggggtccagtttcagttttctgcatatggctagccagttttcccagcaccatttattaaatagggaatcccttccccattgcttgtttttgtcaggtttgtgaaagatcagatggttgtagatgtgtggtattatttctgaggactcattctgttccattgatatatatatatattggtaccattggtatatatatgtatatatatgtctgttttggtaccagtaccatgctgttttggttactgtagccttgtagtatagtttgaagtaaggtagcatgatgcctccagctttgttctttttgcttaggattgtcctggctatgtgggctcttttttggttccttatgaagtttaaagtagttttttccaattctgtgaagaaagtcagtggtagctggacagggatagcatggaatctataaattactttgggcatgtggccattttcatgatattgattttttctatccatgagcatggaatgttttcccatttgtttgtgtcctctcttattccctcgagcagtggtttgtagttctccttgaagaggtccttcatatcccttgtaagttgtatgcctagttgttttattttctttgtagcaattatgaatgggagttcactcatgatttggctctccatttgtctgtcattgcttataggaatgcttgtaatattttcacatttattttgtatcctgagactttgctgaagttgcttctcagcttaaggagattttgggctgagacaatggggttttctaaatatacaatcatgtcatctgcaaacagaaatattttgacttattctattcctatttgaataccctttatttcttttgactgattgcctggtcagaacttccaatactgtgttgaataagagtggtgagagagggcatccttgtcttgtgccaggttttaaaggaaatgcttctaggtttttgcccatttagtatgatattggttgtgggtttgtcataaatagctcttattattttgagatatgttccatcaataactagtttattgagagcttttagcatgaagggtgttgaattttgttcaaaggccttttctgcatttattgagataatcatgatcaacaaaatggatagacctctagtcagactaataaagaagtaaagagagaagaatcaaatagacacaaaaaaaatgataaaaagaatatcaccactgatcacacagaaatacaagctaccctcagagaatactataaacacctctatgcaaataaaatagaaaatcgagaagagatggatgaattcctggacacgtacaccttcccaagtctaaacgaggaagaagtcaaatccttgaatagaccaataacaagttctgaaattgaggcagcaattaatagcctaccaaccaaaaaaagtccaggaccagacggattcacagccgaatgctaccagaggtacaaagaagagctggtaccatgccttctgaaactattccaaacaatagaaaaagagggaatcctccctaactcattttatgaggccagcatcatcctgataccaaaacctggcagaaacacaacaaaaaagaaaatttcaggccaatatccctcatgaacattgatgcgaaaatcctcagtaagataccggcaaaccgaatccagcagcccatcaaaaagcttatccaccacgatcaagttggctttatccctgggatcaaggctgtttcaacatacacaaatcaataaacgttaattcttcacataaacagaaccaatgcaacgttttcctgattcagtcaggcatgacgtactgaataaaaggtgctgttacaaacttgccttcagtaatgttgtgttaaggtgggggaggggagtgttctacagcttgtgagtaggactcagtcttttagctggcctgtgcctctgaactgtggcttcacatatgctgctcagtcacccccgcttaggttggacaggatggctggaaggggttggagtagggtatttcccttctccaaggtgagttaggctctgataaaacaccagcaagttaggctcaggttacctagtttctcttgagggcaggccttgctaagaagaacatagtgcctgagctatttttttttttcatgatctgtggttttctttttaattatcttgtcttatgatcacacataattttaaaacttgtgtatatctcctctactttaatccttttaagttggcaaaagcaccattccaatcacaaatacacagcagttctacagttttatgtttctgaatggctgtttaaagacaatcctaaattataacttagtttgacttagattgtgaagaattcaagaatgaagtttaacttactactattttaaaagcatgtgaccttacagatcaataaaatgtaagaagtgttaaataatctttgatattacacataaatcacactaaaatgcctttcaataagtaaaaggaaccattttaaatatagggaattctaattacactggcatagttaaggccaaaaatataaagtagacattgctaccttatttatcttcaacccttgcctttaagaggcaaattaacacaaaacacaagtgaatcttgcttggttctgagacagtgaagaaatttcccccgtatttaaatatactcacataaccagttatataaatctaaatataaaaccaatctccagtaagttttaagatggtactcagcgtctttgtgaaaagttgaacattactaatgaagtctaacatatctttagaaggggtgaatagcgatagcatttactgaattggaattactattaaaattcaaaaactgaacatattcatttaaccacaagccagtctttgttttaaatcaggactgcccaacaaaatattctgtcagtcattcatgatctgaattctggtgtatgagatctcttaaagtatggtggacataaaaaactcacgggacattctgttttgtaataaataaggcagtggccaactcattagtagcttttttgagataagctatcaagtctgccctttctaccttcttaatgcaggcaaagatcatttttgttccaaggatgtgcttcttgggagtctccaaatacaccatcagtgtatcctctccccaggtgatgcctttgttcttattagcatctgtgtaagagaatccaacagcctgacctgtcttctacccgaagagaccatggagattaggcccagtcttgtgcttgcctcccttttccatgatgtggcactggacacacttctgaacaaagatcttcttgcctttctcaacatcacccatatttaattctcttttaagtctcttgagcaatgaaggttcctgctccgaagccagacgtcacactctattgccttagctatttttaaatgttttcccctcctaccagcagcattggggatttttctccaaaatccactatgagaatctggtcaagatcctggaagtaaaaattacagaagtgtggagacactgataactatgctcccctagagttcttatctctcagacttgtccacactgagcctccagcaagtcatcaatgatacttcaggcttccccacctcagcaccggtttctgcagaggtttttactcagtgatttctgttccaacaatccgtgattcttggaatatgactgtctgtccttccaattttggggacagtggttttccccaatggagataaggagagttgtcgatttttcagttcgtttggctttttccttgttgccaggatggggtagaaacttctaggttcttacacattgaactggaaacctgaagcccctgatactcagaattttagaaagggggtgtttagtttctaagtatttggggatttatctttctagagttgatttttagtctgattccagagaacatactctatatgatttcatttttttcatcctctgcatcatatatcatataattttgattgaggaagacacaaatatatggaaagaactcagaatggcatagattctcttctggcctctcttttattttattggttgatgtgtctgtttttattagtattatactgttttaattcctagctttgaaatacagtttgaagccaggtagtgtggtgtctccagctacactcttttggctcaagattgcctttattgtgtgtgtgtgtgtgtgtgtgtgtgtgtgtgtgtgtgtgtgtggttttaagagaaaagcatgaaagataattctgtgttcagggattggaaaaattaatgttgttaaaacgtctatattacccccaaaagattaatagattcattaaattttttaccaaaatttcaattttacttttttagagataagctctaaaattaatacagaaacacacacacacacacacacacacacacacacacacacacacacacacacaaaaataaccaaggcaattcctatacataggtataggaattaaaacagcagaatactgataaaaaaaaatagacacactgaccaatgaaacaaaatagagaggccagaaaagaacctgtgtgattatgatcaattgatttttacaatggccccaataatacaaaatgggaaaagaacagtctccaataacagggtgacaagaaaatggaattttcatgttcaggagaatgaaattgggttcttatctaacaccatatataaaaacaactctaaacattatatgactttggtctgggcaatgactttttggatttgcctccataagctcaggcaacaatagcaacaacaacaaaaaataaacaaacaggattatatcaaactctaaagcttcctcacagcaaagaaaatgaacagagtgatgaggcgacctatatcatgggagaaatatttataagctgtacatgtgataaggtgttagtaatcaaaatatataaggaactaaaacaacttcaaagtacaaaacaaataacccattaaaattgggcaaaggactcattttgagacatttctcaaaagaagacataataatggccaacatttatgtacatgtgaacctatgaagcaatgcttaacatcactaatcattaggaaaattagaaactcaatgggctatcacctcatatctatcaaatggctattatcaaaaaggtgaaagataagtgttggcaaaaatgtagaaaaaagggaacccctgtatgctgttggtggcaatgtaaatttatacaagccacgttgtaaactgtgaagagctttctctaaaaactgaaatagaaccaccactctgtgtagagccagcaatcccatttctgagtatatatgcaaatgatttgaaataagtatattgaagagacatctgcaatttcatgttaattgctactccactcacaatagccaacacacagaatcaacctaaatgtccatcaactgataaatggataaataaaatatggtatatgtatacataatggaatagtattcaaccttaaaaaagaaggacattatatcatagaagaatctgggggacattatgctaagtaaagtcagccagacacagaaagacaaatgttcccacttatatgtagaatcaaaaccatggaactctcagaagagaagtagtatttacagagactggagaatagggggaatggagagattttggtcaaaaggtacaatgttttgttagactagagtaagagatgataagtatctgaggggaaaaatgcccaagcttattactgggcctttgcaggcatgagtgggtatggggccatggcttttctgtagcatttggctaaagaatatcaattattgtataacagtttctgtcttgctagactgcccctctcaggtcacgtggctagaaggagtaggcttctcttaggtttactggtctgcatccattggtatttctgggctgccagcctctccactatcttgtttgggggatatgacacagagaggcaaacccagagaacttgtcacgtgttgtgagggtcctggggtctctgggttcttagtctgcctgcctcttctctctctttcagggtgtccttacattcattttatgtatgttgtccagggtttgtgatgatacttaggaagaggaataaggaaaagtacatctattctatctccaacatagtactatgtttatttttaaactgttaatgccattttttaaaagaaaaattatttgacttattttgattactctgattgttagtttctcactcttgataaccccaatgaatagtgacaaaaaatatttttaaagttgacagtggaagtaaaattatcatgtggctcttgttgtaactgctgagtagtctggagagagaacttttaacatgtagagacattgttatgtaggcttattttgtaaaataatgttttctataatgcaatgcctagatttcaccttatttttacacatatatgactcaaataagagtagattttatatgagtaaacaatactgaggaatttacgtggcttaagataatttaacccaatttaatttttacacagttattttaaacctcaaatgttaaatataaaatacctgtaaactgctgctaaattatgagttgcagtggattctattgaaggagagactggaaacccaggacagtttgttctggtggaggccactgtctgcataacaagaagctggttgtctccatacctcccttaccccattagttaccattcaatagaacatttttcatcccgaaaatattgaacaacattcattcatcaaagtcaaattttctatttcttgctctgatctctctttaccagactttagataggtaagctaataggtaactgtgagtgatgtctaaaagtactgttactaagatggtttcttacagtatttcaaaattgtatgtggcttgtgatgcaaattattttttgccttgcttactgctgatttgggaataataattgaaggctatcattttcacttaattttatatagcttaatagctatttgcgtgtaaagctttcatcagaacgtattataaatgaaatgtttgagtatttaagatttcattatgagaccaggcttgttttagagggatttaagattatactttacacatatttctacagaaaacaaaacattattttgggggtagaagcaaataatatttaccactttgttctcctgtgtccccatctcaaatatattgaaggcaagagaatatacctatttattaacaattaatgccaaaaattgttgaacttgtttacagaaacttattggaagattttacttatctgctgcccatatgtcctcccatgcatccaagaattccaacagtatgataagtaatttgcaaatctttgaaaaattctaagatataatatatttaataaagtgctacattttaaaatcaccatcttgatatgatatatttttgaagttatgattgtcaataaaagatcatcacccaaaagaaataaattattaataagtgaagagattttatttcatcaaagttaaaaagaaaaggtgagccagggtgtgaaatatgggtctgaaaatgtggttaaatgtggaggctgttacaacgtttctttccttttctaaggaaaataatctaagcagtggtgaaaatggttcagaatagacttagaacttaccatatgtgataatagggaaatactttcaacaaaacatgcattagtttaacaattcatatacatattcccagggcaaatacatcataaccagagcttatttaacaagaaatatggtttctttggggaatattattgcatgagccaccatatgtattacaacattaaacattccaaatagtgcttaattcattggttgtgagaaagcgtcagaaatactgaagaaaatcgtgtgggtttacataggaattgggagaactttgttttatctttttgctgttgttgttgttgatctatataagactaatgtcataatacaaaaaaccttttatactttcttcctctgatagcaaaaattcataaattcttacttcattactcagaaagcttaataaatttcccatctgttttccaaagcctaattaaacttctcagaacttccctagtggaacaggggagtggttcccaattgaagccttgagcggtattatagttttttttgacaagttacaaaagcttattttattgccactgataacttaaaagttgtttctatatataatattcatttagacactaatacagctaggcttactgatatattctcatagtcatttataactaaacattctgagtcacaatacttttctttactgcctctaatattatatgtttatgtatatgtattttttcttaaattataattggacttaacatggagagaaaatcccctgatttcaaaacgtgctgtattctacacacattggtgtagctttattcattgaatttcatgataattccccttatggaaataatgttaaaatatttcctaaactagtgtacacagcatattcgtctaaactactgagtttgagatctgaaagtcatgctagtgcattttgtacagtacataagagaagggaaagaaatttgcttctctatttagtggaacagtgcagaacttgggaagatttttaaatggagctgatcatcggaggctccttttccccaaacatctccttgccccaagtccccaccatctcaggtactacagcatcataagagaaattttcaaatatattaagtattagtgaaattcaagtcagaaattgaggattgactcccattaatactactttctggctagtctctataaatcttcattttctcattgtaaattgtgccttaaagcacctaccttaaagggtcgctctagagaaaaaaaaatgtttctgatttgaacataaggattgaatacataacaaaattaatggaacactttggatgctcagtttttcaaagctcctgactgaagaattcatgatgtgttgatgtttggatttcagaagaagatggctggtaatctaaatgaatccctgtttggcacttgagtcttataaataaggtcttttaatattcacaaggctgggtaggtatttgggatcaaggctctctttctgtcttgtaaataaaggatcagctttcagtctatctggcttttcacaatttgtgactctatctggtatctgaaaccaaaggttttctaaaattccaagatccctttccctctcatttccagctgtacaaagcactggctgtttagactacagagaagacaaaatgaggatgaggcagagcatctgcttaatagcacaggtcctgcataaattcatgtttggagtgcttcgttctgtaaaatagacttaagtagatagaaataagttaggacaaaaattgaactcacatttgtgcaggtgtgtgtttgtgtataacttccataatagcttattttatgtgaaattttatttcaaactaatgattgaattgagaacaggaatgtgtggtgaagaagatatctggacaagatagtgcctctctctcccttagaagagattttaaactcctgggaatcactgaggattctgaattatttttatttttcattgatatattttttctccttgcatataatttattttcaaatctcctattctccatcagaatagtgaatttctctacccgtttgtgttaagagtactctgtactcttaacactctgtacattttctctctcggtagactataaaatttgcattaacatcttatagataaaacaaatatattaactgcctccaaaatagtagctgtcaaagggaacatgcctatagtatgcagcattttgttttatcctttttgacaaaagtaatcatctacgaagagaagaattgtaaataaatttttagtaagtgacccaagtaagaacattttgaaaatcagaattttaaagttgaagaccttctggaagcaatttcccaggaagtaaagtaacaaaacacagagtgtagtaaccaagtactgtattatgttctcatagtaaggtaattgtaacaaaaaaacaccatcatcatcaaagcatttaagggtagaaataataaactgcatttcaactggaaaaacagaattatcctgaagctatacatatgtctatttataattatttgcacaataaagtaagactaactgtataaatttaggtctcctcatgccccaagtaagtttcttaactgcattcatcatgccaccttaacatttatggccataggtatcaagatattggctgacatattaatattcaccaaataatttaatatgagaagaacagtgtaaacctgatattgagatacaaatctcttattttatttacattaatttaaaagagataaagcaaaattttattaaacattgttctattacatcaaaatcctaaaagaacctaaaagattttgaagcaagcagtttagcagagataggcaatgtaataagtttctatttttatttgccaaactcagtaatgaggatcaggagattaagatacataataaaccaataatccaaatcacaaagagtacaggttatagtccttagaaacccataaaatagatgaagagagtaaaggatcaaaacaataggttggattctgatctatgcctataaacgctggaatgcaaattaattgatacttatggaccataaacattttgcaaattactgtgccttaggcattttaagaaatcaaaagtgaatgtgggctggattttcagaatggcatagtaatgacttttgaaattccactcttctggaaaggcaatgagaaaatattcataattatcagaatcaatgttattcagaattgtggaaataaattaaatgtttggaataaccatacagcatttattaaaaacaaaacaagcttcaagttttggtaagaatggagagctttgcaacattgtagcttattatattcctactaccctgtccagaccaccactgtgacctcgaaaatatgcatcctagaaaacatggtagctagctataagacccagcacctcagaacccactgaagggtgtgggctgggcttgcagattctaaaaaagcataatctcaagaagatcataatcatctgacctatctggaagcttcctagagaagtcaatttgcaggctgctatggttttaatatggcttctcccctctgaaactcatgttaaaatttgattctcaatgtgacagtgtgatgaggtggggcctattgggaggtgtctgggtcatagtggtgaataatgccctcttgtgggagtgggtgagttctcattctaggaggaaaaaatggattaatttccatgagaattggttgttaaaacaagtctggcttcacaggtttgtctctcttacttcctctctcaccatgtggtctctttgcatattcccacttcacttccactttctgccatgaggtcaagcaacctaaggcagtcaccagatgtggctgcccaaccttgaactttccagccaccataatcagagccaaataaactgcttttttaaaagataaattatccagtctcaagtatgctgttatagcaacacaaatggactaagaaaattggcatgcagagtggggtgttgctctacagatatctgaaaatggggaagtggcactggaagtgggtaatgactggtggctggaaaaatttggaggagactagaaaaagcctgtattgctatgaatgggatccttagggtgattctggtgaggactcagaagaagacaaaaagatgagggaaagtttggaacttcttagagattcattatgtggtcaggaccaaaatgccattagaaataaaaacagtggaagatatgcctattacacccttgcaaagaacctgactgcattatgtcgatgccctagtattttgtggaaggtcaaacttaagagtgattaatatttgacagaagaaaacttcaggtagtaaagcattcaggcaactgcatggttgcatttaactgcatgcagtaagatttaagagcaaagacatgacctaaaagcacaatttataattaagaggaaagcagaacgtaaagattttaaaaatttgcagaccaattatataaaaagaaaaggcatgtttggaaagggtgctgagggttgggtccagtgagtagttgctaaagagattagcatggctgaaaggaaacccagtgctaataatcaaaataatggggaaaatccctaaaggcatttcaaagatctttgaggccagtctcatcacaggctgagaggcctaggagtacagaatggttttgggggacaggcctaggctgttgaagtcctgtgctgcctcaggatgctgctctccacatcaagagcagccatggctcaagtggccccaagtaaggctcaagactctgctttgaaaggcacaagcagtaagccttggcatccacatggtgttgattctgcaggcctgcaaaatgtgagagctatggaaacaagcctttattgactgagatttcaaagggtatatagaaaaacctgcaggcccaggcagagacttgtcacaggacaaagccaccacagagaacctctcatagggcaatgctgagtggaaatgtggagttagagctctaccaagtcctcaccagcacaatgcctaggtgagctactggggccaccattgagacctctgaattatagagccaccaacaccatgtaatgcccacctaggaaaactacaggaaccaaacttcaatctatgagggcagacacatgtgtgacactcaacaaagccacgggagttgaactgcccaagaccttagaacacacccttcacaacaatgtacacagggtgtgagatatgaagtaaaataaaattatcctggagccttaagatttactgtctgccctgctgtgttttggacttatgtagggcctgtcatttatttctttttgtctagttttcccttttagaataggaacattgaataaatgtctgttatactattttatcttggaaataaataacttgctcttgatttcacagattcataactacaaggaacttgccctgagtctcaaaagagaatttggactttgggctttcaaggtgatgctggaaaagttaagacctttgggaccaaatggagggaatgattgtatttagcattgtaagaagaacatgagttttatgggggcagaggtgaaatgcttcactttgaatatggtttgttcctctgaaactcatgtcaaaatttgattcccaatatggcagtgttggaatgtgaggcctagagggaactgttcaggtcatgggggtagattcccccataaataaattaattccctgctgcaaaggtgggtgagatcttactcttgtggaaatgcattatttcccacaggagtggtttgttaaaaagagtctggcttcctcagtttctctgtcttgcttcctttctcaccatgtgatctctttggacatgcccactccactttccctttctgccatgaggtgaaacagcctgaaaccttcaccagatgcagctttcccaccttggacctttcagtcaccagagtaatgaaccaaataaacctcttttttctgtaagttacccagcctcagatattctattatagcaacacaaacggactaagacacaggccttgtcattacttgacctcactcagacctttctcattggaaaaattgctaacctaagtatttaacaatcaacagtttaagatcacacctacttgaattggcaataccagttgtggcaagaaagatgctggtgaaaaacttaagatctgaggaatgaggttccaatgagggtcttttagaagctccaatacattcctgagaacctagaagggcacatgaatgtgccgagctatgcacatgatgagaaaagatgccctaaactctcagttctggctagccttaaagatctgtgcaagaagaaagtaaagacttagaaagagttgtaaatttccagaggattaaagaagtgccacaaaacacacacagagccccatggaaaagttgtaagactttgcttctagtaatttacagaaatattggtcaaaacaatagatgaccaagaagctaaatagacagaaatagtctgtttcctatcagtgaaacagataggaaaacatcaacaacaaactgcaacagcatcagactcttgggaagaatgagaatctgatgtccaagaatattctttgaaatgccagttttaaacaaaaattatgggacattgaaaacattctcaaaattgtggcctttctgtaagaaaatagactcaatagaagctttctttgaggaaaaccagctggtgcacttactagtaaaataatttcaattgtgtattacaaatatattaactggtctaaatgaagctatgcccaaagaattaacctgtttgaccaaatagagaatgttaatgaaaggatagaagtaatgaaaagaatcaaataaaattttcagttgaaaagtacaattactgaaattttaaaaattctgagatgaactgaacaaaacatttgagtttatgaagaaagattaagagaatatgaagagttcacaatatctcaatgtcaatagggcaactgagattatccagtctaaggaataacaaaaatataaatgaagaaaaatagcagagtctcagaagtctctataacagcataagttatactgtcatatatataaagggaataccaagaaaacaagaagggacatggatagaaacaatattttaagaaataacagctgaaaacttctcaaatttaatattaatatacatatttgaagagctcagtgaactccatgtagaataaaaacaaaagacataaaattatcatgattcaccagcaaaaggccagagaatcttgaaaacagcaaaataaaaatgactcacaacatgcaaagagtcgttaataagaataacagctcattttttatagtaaactgtggaagttagaaggtaatagaacggcacatttaagtgatgaaacaaaaaggctgtcatataagaggttcttatttagtgaaactctccttccaaagtggaggagaattaagtcattattacatataaaaaaaagaacatttgccactagtaaatatacactacagaaaataatttttagataataacttgaatacacacttagaaataataaaaacaccattaaaggtaaatacataattcaatataagtgacagtataaatgcatttttattggtgttttacttctaattgatttaaaagaaaaattgataaaatgataattatatcactgtgtctttgggcttgtaatatataaagatgtaaagtgtatgacaataataacccaaagaagtggggggaacagagttatatagaaacaaatttttgagcactattgacgttgtcattgttctgaactagaatgttttaaaatattattatatccctccaaataactaataaaataactaatgataaaaatgggagaattaaaattatatgaatgtagtatatacttatatataatttatataaaagtgtatacatatatatacatgtacatatatagtgttataacccccaaaataaaaacagtaatggaaaaataaaggaacaaagataaaaacttatgatataaagtgaacataaattttaccttatgtataattgcattaaaagcaaatatattaaatatttcgaccaaaggcagagattaacataatgcatttccttaaatgatttagctatatgatgttctcatgagaacttgtttaaatttttaaattgaaaggtactctagtgtatatatgactacaatcaagagattgacagtgaaacagtcaaagcagaacacctgcatcctgatcctgttctatttttattgttattcagttcaatgtatttttttatttcttttgagactctcttgtatataaaggattatttataattctgtgccttcattttcaagtgtcagaaattatttttgttttctttctgtttctttcttctctggtcagaaaacacaccttctatgactttaattattttaaatttattgagatttgttttatgcccccagtatggtcaagtttctacagaaacttgcaaataatgtatattctatttgtattgtccaaaagttctaaaaatgttagtttgatcttgtcagttgatggtgttttctaattcttctacattcctgttgatgttctgtttaactcttttaccaattgttaagagagatgttgaagtcttcaatgtaattgtgtatttatccatttcacctttcaattctatcagtttctgcattacatactttgcatctaagttatttgatgcatacatatttagagttgatatgtttttcttgtagatttatgcttgtattattaattaatctgtctcatttcatccaataattttctttactttgaagtttagctcatctaatgctaatatagccactagtcacttttcttcatccaaaaaaatcattcttttactttaaatataactatatcattatatttaaagtgagcttgtagatagcatatatttgggtcatgttttttaatctattctgccaatctctgtgtattgattggtgtatttagacaacttacttttattttaattattgatgtgttgacatatttataattatatatttgaattttgttctctctcttttccatttttctgttttaatttttctgccttcttgtaacttttttgaatatatgcttttagaaatcaattttatccatagcatttttgagcatacttcaacatatactgttcttagtgtctactctcagcattaaattttgtatatatcttcacattctagtgaaatcaacatcttatcagttaggtgtagaaaccttaacatattttaagtctctttacctattttattatattttacattttataatatataatatattatagcttataatatttatatgttatatttaagcatatattaacatatacttatgtactataaatattgtttatatttataatatatagatatattatgtcttatatttcatattttatactattctttatataatattttaaaatatttcatttacatatagtaagaaccaaaccagacaatattacaatttttgtttcaatacccaagtataagttagaaaactcaaaagcagaaataaaatatttaaggatcacttttcttaccatattctttctttcttcctaagttccaagatagcttctataattattttctctttttgtcctttttaagccatgcttttaggataggtcttcttattataactttactttgtttttctttagctgagaatgtcttgattttcccttaatttctgaagcactattttgctggatataggattcaggattgacagttcttttctttcagcagttgaaaaatcttgtgccacttccttctggctgtatgatttctgatgagaaattctctgtcatttgacttgtgttctcctataggtaaggttttatttctctcttgctgctctcaagactttttgctgtcaagttttcagaagctgactatgatgtgtcttggcaaggatttctttgagtttatcctctttgtatttcacttagtctcttaaatctataggatgtattctttcaccaatttcaatgaattttcgctattacgtctttcaatatttttcagttccctaatttttgtcctcattttttggactctgaagacatgaatagcatatatatatatatataataatataatatatataatatatatatttgttttagtctcacagttcactgaatagtctttccttttttcaatctttcttacaacttttattctaactggttaattctcacaattcttttatccagttcactgactcttctgttctcttctttctgctgttgagccatctattcagttttttatttctgttattatatttatcagttctaaaattattattgtattcttttttatgtcttttatttcttcctagggtttctgtttcttttctgagactttctacactttcatttgttctaagcatggtgataattgcttattggaacaattttgttgtgactactttaaaatatttgtcaactgattctaaaatctatgtcatctcactgttggcatcttttgaattttttttccattcagtgtgagttttctttttttctctctctctcttttttttaattttttaaattttattattattatactttaagttgtagggtacatgtgcacaatgtgcaggttagttacatatgtatacatgtgccatgctgctgtgctgcacccattaactcatcatttagcattaggtatatctcctaaagctatccctcccctgtccccccacccgacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggccgcatagtattccatggtgtatatgtgccacattttcttaatcgagtctatcattgatggacatttgggttgcttccaagtgtttgctattgtgaatagtgccgcaataaacatacgtgtgcatgtatttttatagcagcatgatttatagtcctttgggtatatacccagtaacaggatggctgggtcaaatggtatttccagttctagatccctgaggaatcgccacactgacttccacaatggttgaactagtttacagtcccactgacagtgtaaaagtgttcctattcctccacatcctctccaggacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttctttcttgtaaatttgtttgagttcatagtagattctggatattagccctctgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggtttcaggtctaacatttaagtctttaatccatcttgaattaatttttgtataaggtgtaaggaagggatccagtttcagctttccacatatcgctagccagttttcccagtaccatttattaaatggggaatctttccccattgcctgtttttctcaggtttgtcaaagatcagatagttgtagatatgcggcgttatttctgagggctctgttgtgttccattgatctgtatctctgttttggtaccagtaccatgctgttttggttactgtagccttgtagtatagtttgaagtcaggtagtgtgatgcctccagctctgttcttttggcttaggatggacttcgcaatgcgagctcttttttggttccatatgaactttaaagtagttttttccaattctgtgaagaaagtcattggtagcttgatggggatggcattgaatctataaattattttgggcagtatggtcattttcacgatattgattcttcctacccatgagggtggaatgttcttccatttctttgtatcctcttttatttcatcgagcagtggtttgtagttctccttgaagaggtccttcaagtcccttataaggtggattcctaggtattttattctctttgaagcaattgtgaatgggagttcactcattatttggctctctgtttgtcttttattggtgtataagaatgcttgtgatttttgtacattgattttgtatcctgagactttgccgaagttgcttatcagcttaaggagattttgggctgagacaatggggttttctagatatacaatcatgtcatctgcaaacaggggcaatttgacttcctcttttcctaatcgaataccctttatttccttctcctgcctaattgccctggccagaacttccaacactatgttgaataggagtggtgagagagggcatcctgtcttgtgccagttttcaaagggaatgcttccagtttttgccaattcagtataatattggctgtgggtttgtcacagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgtgtatactgaagcagccttgcatcctagggatgaagcccacttgatcatggtggataagctttttgatgtgctgctggatttggtttgccagtattttattgaggatttttgcatcaatgttcatcaaggatattggtctaaaattctcttttttggttatgtctctgcctggctttggtatcaggatgatgctggcctcttaaaatgagttagggaggattccctctttttctattggttggaatagtttcagaaggaatggtaccagttcctccttgtacctcttgtagaattcggctgtgaatccctctggtcctggactctttttggttggtaagctattgattattgccacaatttcagagcctattactggtctattcagagagtcaacttcttcctggtttagtcttggtagcgtgtatgtgtcaaggaatttatccatttcttctagattttctagtttatttgcatagaggtgtttgtagtattctctgatggtagtttgtatttctgtgggattggtggtgatatcccctttatcattttttattgcatctatttgattcttctctcttttcttctttattagccttgctagtggtctatcaactttgttgatcttttcaaaaaaccagctcctggattctttaattttttgaaggcttttttgtgtctctatttccttcagttctgctctgattttagttatttcttgccttctgctatcttttgaatgtgtttgctcttgtttttctagttcttttaattgtgatgttagggtgtcaattttggatctttcctgctttctcttgtgggcatttaatgctataaatttccctctacacactgctttgaatgtggcccagagattctggtatattgtgtctttgttctcgttgctttcaaagaacatctttatttctgcctttatttcattacgtaccgagtagtcattcaggagcaggttgttcagtctccatgtagttgagcggttttgagtgagtttcttaatcctgagttctagtttgattgcactgtggtctgagagacagtttgttatcatttctgatcttttacatttgctgaggagagctttacttccaactatgtggtcaatttaggaataggtgttgtatgttgctgaaaaaaatgtatattctgttgatttggggtggagagttctgtagatgtctattaagtccacttggtgcagagctgagttcaattcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccgtttaccattatgtaatggccttctttgtctcttttgatctttgttggtttaaagtctgtttcatcagagactaggattgcaactgctgcctttttttgttttccattttcttggtaggtcttcctccatccttttattttgaatctatgtgtgtctctgcatgtgagatgggtttcctgaatacagcacattggtgggtcttgactgtttatccaatttgccagtctgtgtcttttaattggagcatttagcccatttacatctaaagttaatattgttctgtgtgaatttgatcctgtcattatgatgttagctggttattgtgcgcgttcgttgatgcagtttcttcctagccttgatggtctttacaatttggcatgattttgcagtggctggtaccgttttttcctttccatgtttagtgcttccttcaggaactcttttagggtaggcctggtggtgacaaaatctctcagcatttgcttgtctgtaaaggattttatttcactttcacttatgaagcttagtttggctggatatgaaattctgggttgaacattcttttctttaagaatgttgaatattggcccccactgtcttctggcttttacagtttctgccgagatatccactgttagtcggatgggcttccctttgtggctaacccgacctttctctctggctgcccataacattttttccttcatttcaactttggtgaatctgacaattatgtgtcttggagttgctcttctcgagaagtatctttgtggtgttctctgtatttcctgaatctcaatgttggcctgccttgctagattggggaagttctcctggataatatcctgcagagtgttttccaacttggttccattctccccgtcactttcaggtacaccagtcagacatagatttggtcttttcacatagtcccacacttcttggaagctttgttagtttctttttattcttttttctctaaactttccttctcacttcatttcattcatttcatcttccatcactgatactctttcttccagttgatcgcattggctcctgaggcttctgcattcttcacatagttcttgagccttggctttcagctccatcatctcctttaagcacttctctgtattggttattctagttatacattcgtctaaatttttttcaaaggtttcaacttctttgcctttggtttgaatttcctcctttagctcagagtagtttgatcatctgaagccttcttctctcaacttgtcaaagtcattctccatccagctttgttccgttgctggtgaggagctgcgttcctttggaggaagagaggtgctccggtttttagagtttctagtttttctcctctgtttttccccatctttgtggttttgtctacttttggtctttgatgatggtgatgtaagatgggtttttggggtggatgtcctttctgtttgttagttttccttctaacagacaggatcctctgctgcatgtctgttggagtttgccagaggtccaccccagaccctgtttgcctgggtaccagcagcggtggctgcagaagagccgattttcatgaaccgcaaatgctgctgtctgatcgttcctctgatagttttgtctcagaggagtacccggccgtgtgaggtgtcagtctggggggtgcctcccagttaggctgctcgggggtcaggggtcagggacccacttgaggaggcagtctgcccattctcagatctccagctgcctgcttggagaaccactgctctcttcaaagctgtcagacagggacatttaagactgcagaggttactgctgtctttttgtttgtctgtgccctgcccccagaggtggagcctatagaggcaggcaggcctccttgagctattgtgggctccacccagtttgagcttcctggctgctttgtttacctaagaaagcctgggcaatggcaggcgcccctcccccagcctcactgctgccttgcagtttgatctcagactgctgtgctagcaatcagggagactccatgggcatgggaccctccgagccatgtgcaggatataatctcctggtgtgccattttttaagcccgtgggaaaagcacagtattcgggtgggagtgacccgattttccaggtgccatctgtcacccctttctttgactaggaaagggaactccctgaccccttgcacttcccgagtgaggcaatgccttgccctgcttcggcttgtgcacggtgcgctgcacccagtgtcctgcgcccactgtctggcactccctagtgagatgaacctggtacctcacatggaaatgcagaaatcactggtcttctgcgtcgctcacgctgggagctgtagactggagctgttcctatttggccatcttggctccagaacttcagtttgagttttcactggttcttggtatgatgagtgatcttctattggaattacacatttttgttatttagttatgatattccaaatcttacataaacattatgttttatctaattgccattgatatagctttatcaaagtaagggagaatgccatgttgttcttgccagataggggtagaatttcaggtttactactttacctccactggaagttaaacagtgggctcttcataactactgtaaaagagtaggagatccagttcgccagtaggctttcactgatcccgccctgagtagggtgggtggagttatctcattaacatttacctttaaaatttccttacgtttgttttacatataatatgcaaataattcagtcctacttagtgggagtaaaagggacagatatgtctactccatcttcctagagaagtagaattatccaagctttatagctaaacacacatgtaggttgcaaataaaaggatacaaatatatatatcttgtatataataatgaaaaaagaacccgaataactatagtaattttacaaaaaaggctttaagtcaaaaattgtttcaagatactaaaaagggcattttataatgaaaaatgaatcaatttttcaaggagatataacaattataagcatatttgatgataacagagctccaaaaggtatggaacaaatgaggcgaaatcgaagagaaaatggaaggtaccaccaattagttgtagacatcagtaccccactgtaactaatgggtagagcaattaagcagaagagtaacaatgatattgacttggtcagcatgataggcaaccagacatgttgacctgtttagactctccacccaattacagaagaacatacatttttaactaaaatatgctaatatctaagatctaactacaatacactaatatctaagatcacttgtatgtcaggttataaatcaagcctcactacatttaaaatagttaaaataatacaaattatgttctatgaacacaatggaataaaattagaaatgaataacaaaagaacaattgaaacatatgcaaatatgaggatattaaaagcaaattactaaataaccaatgggtcaaaaaaaatcacggtgaaattataaattattgggagataaataacaatgaaatctcatcatgctaaaacatatgctacgcagctatagtttgtttagagaaaaattttaacttcaaatactatattaagtaataaaaaaatcttaaatacctaatctttctcaataagaaattagagaaagagcaaaataaacacaaagtaagcaggaacaaggacaattataaatttagaccagaaatatataaaaaaagaatacataaacaattgagaaaattagaaaatctcaaatttagttttttaaaaaggttaacaagagtgacaaaactttaactagataaccaaacagcgagagagagaatattcaaattttttaaaatcagaaataaaagaaggtatattttagagattaaaaagaaaaacgtaactataaataattgctaaacatttacataatttaatgaagtgtgtaaactctgagaacaacaccaactaatgaaactgactcaaagataaatcaataattggaatatacctaaaagaaggaaagatattgaaatggtatttttaaaacacttcccacaagaaaaagccccaaatcaagaggtttgtctgatgaactccattaaacaatgaaaaaacaattattaccaatctttcacaatcttttcaaaatatagaaaaaggggaaacactcctctacttatttgagattcgaattagcttcatagcaaaaccaaaaccatcagatgaaaagaaagccatagaccagtatccctaatgggggtagatgaaacaatctttaacagaaagcttgcaaaccaaatccagcaacatgcaaaaattgttatacaccattatcacttggtatatatccctggaatgtatggtagatatatatcttaaaatcaatcagagcaatacaccgtattaattgaataaggacaaaaatacataatcattgtcatagattcaaaaataagaaaaaaataaataccatttcataataagtatactgaagaaaactaagtattgaaggaatgtatgtgttccccctacaattaagaataagaaaaggatgtatgccctccccactttcatcaaccttgtgttggaatttctagccaaggatagatgatacaaacttaaatatagaaaatgttcatgaattcactaagaaaactattggtactaactagtaaatgacttctgcaaggttgcagcatacaatcccaatgcacaaaaatcagctgtatttttatatgttagcaatggattagagtaggtaaaattaagaaaaaatttcatttataacagtatcaaaaaattctaaggaatacatttaacaaaagaagtgcaaatattgtgtactgaaaactacaaaacatggaaagaaattcaagaagatttaaataaggggagctacatcccatgtgcataaattagaaaacttaatacttttaatatgacaatactccaaaattaatatgcagatttaagaaatctccatcaaaatgccaactgcctttttttcagaaatggacaagttgatcctgaatgtatatgaaatccagtatagccaaaataatcttggcaaataagttggagagaacccccagttccatatttcaaaacactacaaagctatggtcaccatggctttgtggtattgtcataagaatggacatatagaacactggaatacaattgagagtctagaaatgaaccttatttattgttaactgtcttttaccgtgcttttcaacacagcagaatgtggaaaggaacaggtttttcaacaaatagtgctgggaaaaccggttattgaatccaaaaaattaagttgagtcctttcctcataccataaaaaattacttaaaaatgaatcatcaaatatatctaagagctaaaactgtaaacctatttgaagaaaacatgggattaaatttttgtaaccttgggtttgacaattgtgcttagactccacaccaaaagcacaagaatcaaaggggaaaaaaatagacaaattggactttttcaaaatttaaagcacttgtgctgagtaatactataaaaaaggtgaaatacaacttgcagattggcagaaacattttcaaatcatttatctgttaaggagactgtatgcaaatatataaagggttttcagagaaaaaaaaagaaaagaaacataaataccccaaataaaaattgacaaaggattcaaattgacatttctccagagaagatattcaaattgtcaataagcacaagaaatgatgctcaaatcattagtcatcaaaatgcaaatcaaaaccacagtaaaatacagcttcccactctataggatggttataatatttttttaaaaaaagaaactagacaataataatgattagtgaggatgtagagaaattggagcactcagattttgctagtgagaatgtaaaatgtggtaactcatttaaacaaaagttcaacattttctgaaaaagtgcaagctgaagttgtcatatgacccagcaattccacttctagatatattcaagagcaattagaagatattcccaaacacacaaaaaagaaactctacacagatgttcactgcagcattattcacaaaaaatcaaaagtaggaacaacccaaatgttcaacaggtgatgaatggggaggaagagatatgtccatatcaggaaatattcatcaataaagagaaaagaagtactatctatgccacaacataggtgcaccttgaaaatagtgtattaagtgaacgtagataatcacaaaatatcttatgtgtatgatactatttatatgaaatgtccacaaaaagcaaacccatagaaagacaaaaaaataatgcttatcaggctctgaagagagaggaaatgaggagtgacttgtactgggtataggatatatttttggagtgataaaaatgttctaaaatttgatgatgatagttgtacatctgtgaatattctaaaatccgtttacttgcatgctttaaacaggtgagtattatagtatgtgaactatatctccctaaggctgctgcagaaaaaaggtgaatgacacataaaggggatgtcaagccagggaacatattcatttacacaataatgacataagtaaatctgaccataatggcattaacaagaaataaacctatgaataatgatggagctatttgtttttctctaatgactgcaaggccattaagaatattagagttaaatctggcctggaagaagagatgacaatcacagtagaaatgaaagagaagcctatcttgaaatcaagagccataatggaaacataataatgctattaagcaagtgatttacagaatgtaattttctccagcagtttcaatatttttttgtcctcacattctaagagactcacttgagttatggtttaatgatctattgaatgttgcatggccatgttactgtgggaaacaggtatgcaaatgtagatgatgacttagttggctctcaattttgttcagaggactcaagagttattgacccacttatgccattattggaacgctaagcgtgtgggagttgtttatattctacttctcaaggtcatcagcaaggtctgattgcaaaaattcaaaaaattgcggtctcaggcataaatgggttgaaagcttttaaggagcaagcagaatgaggaagataaattccagattttatgcctaaaatgatatctataagttagtagtttgtccaaattctcaacacttcctgctttatcctatcaggctatgactttgctttgtatcccacttaaaacacagaatgaagcaaagctacacactaccaaatctacccaccttccttgagttgtacccatatactgtgcctcatctcctgcggcctcagatcaattgtccaggtttccatccatgtccagcctctccatttttgcaccagatctcaccctgctcaagaatacagtttctacaattgtcctcagatttgatatctcaaccatttcatgccagcaattctacaaatatatactaatttcataaaccttggaaaaacattcttgatttcctattgatatattcctatgccccctttaaaaaggaaaagaaggatttcttttccaaagagaagctgcttgtagtagacttgcctgtagtaactctaataccttcacatgcaggctctcatgaagccattcttatgaagtttttgtttccacttctccataaaacgactcttgtaaaggattaaaatggcctctgtgttgctaaattcaatggtcaatttccagctgtcattttacaagactcccgggttttgcactcactttcttggcaactacagctatttcttctttgctggttctaccccatctttcttacatttttatactgtggagtctcagggatgagtgcccagtcattttctctacctatcctgcacaccttgatcttctcatccagaccacagtgctttacctaccatctatgtgctgacagaagctgaacttctattctgaactctaatttttcccttaaatccacactaatatatgcagttctccacttatcacctatatgtctaatatgcgttcagatgtaacatgcccaaaaccaaaatcttgatctttacttccaaacctgcttttcccataatttctccatttgcagagcaacacgttttttccagttattgaaatctactttcaaattcaacccctttccatatagaaaactttgtaacttctccttctttcaatccaattctcataaagctcattctcaatagtctaaccagaatcatcattttctgacttttgtcaatgcctgtcactcctctgctcaaaaatttcccatggtttcccatgtcgctcatagtaaaactcataaaggctcatgcagcatgcaaagtgttttctttgatctcattgtctgccaagtacttcttaattcattccattccacacaaaataacccttgcttttcttctgactctcctggaatgtccctatctctgggcctttaaaattataattcttgtgtctggaatatttccccacaaacatggaaatggctcactccatcttccctttcaagttccatatacaaggcaacatgaattttccttcccacggccctttgagtagtctttgctgtctcctccgctttatttcttgatggtaactgtcatattctgacatattgtccttaatttatttctgcccttagtcacattttgcctcctgtcactggaaagtaactcccatcaggactgttttgttcctttgtttgtttttgtctgttttattcactgctatcttttaacaacaacaaaaaagagtagatgcataggaagcatttggtattttattgaatggctgactctttacatttttgaagatagcttatatttagtgatatctgagggatcatgatgatcataagactttttttacaagggaaacttgtaagtctgtgacttggtggaagctgtcggtggatggatagatagatgttcatcatcagtggatgtttgataggtggtaagaatgcaggtctagtactcacataagaaattagtaaatgagcagtgtgagtttacataaaaggaatcgttgacaccctaggagtggaaatggttgccaaggctgatcactgaggcagaggaaagatgtgtgggcattgtaatgaagagtcaaacttggatccatcttggtctcctgctttctcttctaatcacctgctattatttcccgtctaccattacttcaaaatgggtataaaaagtttaaagtgtcaatctatatcaaattattgataaataattgacaaggtgggagtaattgaaaatttttatttttctaaagatgcctggatacttagatatttaagggttgtttatttttggtaaccaaaatataacctctattttaataaagagatggcagaattacctttgagaaaaagttatttgccatactattttcacccaattgtaacactcaactatattctcctccttaccaagaatgaattgcttatttttgttgttgttgttttattttttaataacatgcaagaacattttacattttcccaaaatttccaaacctttcacattaggtggatttaatttgggaagatagagaaagtatttaaaatgtgtttgggaaataaactggctacaccaagcattatggggtgaatggaggatttccagggtgagttaaggcaaagagaaacttgcttatttacaaataacatgactagtgccactgaagcagattattataaataaagcttctaagatcattatgatggagttactaaaaacttttttggtggaaatatctaagggaattagaatagttaaatgaataacctcttctattctctaggacaagttgctatttcacaaaggaaactatcaaatattgaaggtttcaagggagctactgagaaagcatagctatgtcttctatattatagggacacctgaatatatattatggggtatcgtactcctgttgcatgacctgagaaaatactcctcggatgaattattttatttaaatagctgtctggtacacgacagatattacaatgtgtcataaagtattgaatattttgtaatattttccactgccacatgtaagttgtaaacacagtcatgtacatatcaattataattctaaattctttattacatatatgtagtgaaatatataataaaatagcaatgagtttgtcagaaatttcatatgctttattaccctctagttaccctccttgtgataagttcatcgtattgatttcattaagcacacaaatgtattagtctttcaatcatcttgaaattaagacatgtttatgtgattattgatggtctttaataataatactagcaacatcatctttctaaatgtattctgagcatagctttaagattttatagttattttgacaaaattatggtttgaaataactttttctgttttcactgcaatatatatagtttggttgccactggtaataaatgggttacaaatttcctttggtatttaaatgagaaacctatttctaaaaatccaaaatgaattagtgagctctagtttattttttttttttttagtaaatatgccacataaaccattaaacagccagccacaattaaaattaatgcaggaattattttttgaaagtgaaccatttggctcctctggttataagagttcatatccccttacttctagcatttcttattcagtttcttatggcaaatattaactcattctagagaatactcaagaatagttttaaattgccctaatccatatttatcatctgatgtgtgcacaaagagataaaaatacttttaaaagtacttccaagtttatctttaattgtacattatcaagagtaaaattttggcaaaatatatttatcaatcagtgctaaaagaacattcatagatggtaagagtgattagtcctcctacctcttatccaccatgtattgaaataaattttcactacttacgatgtttacacgttgaccaaaaatgtctacatttgaaattagtttccacatgttacatatcatagattctagataagtgtattgaaattgaaaaaaaatctagctattataaatttttaaagacattaatttttatgttatctgacctgtttctctttccctttcaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtat
